(12) United States Patent
Pridmore et al.

(10) Patent No.: US 7,875,421 B2
(45) Date of Patent: Jan. 25, 2011

(54) **LA1—THE GENOME OF A *LACTOBACILLUS* STRAIN**

(75) Inventors: Raymond David Pridmore, Lausanne (CH); Beat Mollet, Lausanne (CH); Fabrizio Arigoni, Genève (CH); Josef Hermanns, Epfenbach (DE)

(73) Assignee: Nestec S.A., Vevey (CH)

( * ) Notice: Subject to any disclaimer, the term of this patent is extended or adjusted under 35 U.S.C. 154(b) by 0 days.

(21) Appl. No.: 12/244,581

(22) Filed: Oct. 2, 2008

(65) Prior Publication Data

US 2009/0098053 A1    Apr. 16, 2009

Related U.S. Application Data

(60) Division of application No. 10/961,644, filed on Oct. 8, 2004, now abandoned, which is a continuation of application No. PCT/EP03/02882, filed on Mar. 19, 2003.

(30) Foreign Application Priority Data

Apr. 9, 2002    (EP)    ................... 02007932

(51) Int. Cl.
  *C12Q 1/00*    (2006.01)
  *G01N 33/554*    (2006.01)
(52) U.S. Cl. .......................................... 435/4; 435/7.32
(58) Field of Classification Search ....................... None
  See application file for complete search history.

(56) References Cited

U.S. PATENT DOCUMENTS

| 5,603,930 | A | * | 2/1997 | Brassart et al. | .......... 424/93.45 |
| 5,652,838 | A | | 7/1997 | Lovett et al. | |
| 5,815,333 | A | | 9/1998 | Yamamoto et al. | |
| 6,005,728 | A | | 12/1999 | Bang | |
| 6,110,725 | A | | 8/2000 | Delley et al. | |
| 6,258,587 | B1 | | 7/2001 | Delley et al. | |
| 6,410,016 | B2 | * | 6/2002 | Maruta et al. | ............ 424/93.45 |
| 6,929,793 | B2 | * | 8/2005 | Spivey-Krobath et al. | .. 424/93.4 |
| 2003/0049231 | A1 | * | 3/2003 | Baur et al. | ................. 424/93.4 |

FOREIGN PATENT DOCUMENTS

| EP | 0 768 375 | 4/1997 |
| EP | 0 875 579 | 4/1998 |
| WO | 96 33276 | 10/1996 |
| WO | WO 02/12506 A1 * | 2/2002 |

OTHER PUBLICATIONS ("elucidate." Merriam-Webster Online Dictionary. 2009. Merriam-Webster Online. Dec. 14, 2009 http://www.merriam-webster.com/dictionary/elucidate).*
Pfeifer et al., "Probiotics in Alimentation: Clinical Evidence for Their Enhancement of the Natural Immunity of the Gut," Probiotics, Other Nutritional Factors, and Intestinal Microflora, Nestle Nutrition Workshop Series, vol. 42, pp. 243-257, XP-001104004.
Walker D.C., et al., IS Elements are Associated with the Lactacin F Operon of *Lactobacillus johnsonii* NCC533, One of Which Disrupts a Two-Component Signaling System and Bacteriocin Production, Abstracts of the General Meeting of the American Society, 100th General Meeting of the American Society for Microbiology; Los Angeles, vol. 100, 2000, p. 361, XP008007077.
Kim et al., "Conservation of the Major Cold Shock Protein in Lactic Acid Bacteria," Current Microbiology, vol. 37 (1998), pp. 333-336.

* cited by examiner

*Primary Examiner*—Mark Navarro
(74) *Attorney, Agent, or Firm*—K&L Gates LLP

(57) ABSTRACT

The present invention pertains to the use of the DNA sequence of a *Lactobacillus johnsonii* strain, in particular to its genomic sequence for elucidating interactions of microorganism with hosts they colonize, and moreover for elucidating the basis of probiotic properties exhibited by such strain. In addition, the present invention also relates to methods of detecting nucleic acids or polypeptides of *Lactobacilli* and related species, respectively. A data carrier is provided comprising nucleotide sequences and/or polypeptide sequences of La1.

4 Claims, No Drawings

LA1—THE GENOME OF A *LACTOBACILLUS* STRAIN

CROSS-REFERENCE TO RELATED APPLICATIONS

This application is a divisional of patent application Ser. No. 10/961,644, filed Oct. 8, 2004, now abandoned which is a continuation of International application PCT/EP03/02882 filed Mar. 19, 2003, the entire content of patent application Ser. No. 10/961,644 and PCT/EP03/02882 are expressly incorporated herein by reference.

BACKGROUND

The present invention pertains to the use of the DNA sequence of a *Lactobacillus johnsonii* strain, in particular to its genomic sequence for elucidating interactions of microorganism with hosts they colonize, and moreover for elucidating the basis of probiotic properties exhibited by such strain. In addition, the present invention also relates to methods of detecting nucleic acids or polypeptides of *Lactobacilli* and related species, respectively. A data carrier is provided comprising nucleotide sequences and/or polypeptide sequences of La1.

Lactic acid bacteria, i.e. micro-organisms that produce lactic acid during their (fermentative) activity, are known for a long time and comprise e.g. the genera *Lactococcus, Lactobacillus, Streptococcus, Bifidobacterium* and *Pediococcus*. These bacteria are usually prominent in milk and also in milk processing factories, respectively, living or decaying plants and represent a constituent of the intestinal micro-flora in mankind and animals.

Lactic acid bacteria have been utilized as agents for the preservation of food taking benefit of a lowering of the pH and the action of products generated during the fermentative activity thereof to e.g. inhibit the growth of spoilage bacteria. In addition, lactic acid bacteria have also been used for preparing a variety of different foodstuff such as cheese, yoghurt and other fermented dairy products from milk.

Lately, lactic acid bacteria have attracted a great deal of attention in that some strains have been found to exhibit valuable properties to man and animals upon ingestion. In particular, specific strains of the genus *Lactobacillus* and *Bifidobacterium* have been found to pass the gastro-intestinal tract in a viable and live form without getting destroyed in the upper part thereof, especially by the impact of the low pH prevailing in the stomach. Moreover, they were found to be able to colonize the intestinal mucosa, with their temporary or sustained presence in the gut being postulated to bring about numerous positive effects on the health of the living beings. These strains are generically termed probiotics.

EP 0 768 375 discloses such a specific strain of the genus *Bifidobacterium*, that is capable to become implanted in the intestinal flora. This *Bifidobacterium* strain is reported to assist in immuno-modulation, being capable to competitively exclude adhesion of pathogenic bacteria to intestinal cells, thus supporting the maintenance of the individual's health.

Apart from *Bifidobacteria*, also some strains of *Lactobacilli* have been found to exert favorable properties to humans, such as preventing colonization of the gut by pathogenic bacteria or obstructing rotaviral infection. In particular, PCT/EP02/00958 discloses such a strain having both of said properties.

In the last few years the food industry has applied such strains in products, such as milk drinks or fermented acidified milk products. Clinical studies performed with these products and/or the bacterial strains confirmed the notion that these kind of bacteria account for health promoting traits in vivo and may even be utilized for contending diseases, such as ulcers. In particular, a strain of the genus *Lactobacillus johnsonii* has proven to be capable to combat *Helicobacter*, an acknowledged cause of ulcer in man.

In view of these valuable properties particular strains of lactic acid bacteria may provide, there is a strong desire in the art for elucidating the molecular basics of these health promoting properties. In particular it would be of great interest to determine the substance or substances responsible for these effect(s). To this end, tools are required to study these micro-organisms in more detail, so as to clarify the molecular principles underlying the probiotic properties, such as interaction with the hosts, the phenomena of passing (survive in) different environmental conditions in the gut as well as having the capability to adhere to the intestine's mucosa and eventually the involvement in the enhancement of the immune system and defense against pathogens, which information will allow a better understanding of these mechanisms.

Consequently, there is a need for the provision of substantial data about bacterial strains that exhibit properties beneficial for man and/or animals. This is now provided by the present invention.

SUMMARY OF THE INVENTION

The above problem has been solved by providing the DNA sequence making up the probiotic strain *Lactobacillus johnsonii* La1.

In one aspect the present invention relates to the use of a nucleotide sequence of the lactic acid bacterium *Lactobacillus johnsonii* La1 genome having the sequence SEQ. ID. NO. 1, parts thereof or sequences homologous thereto for elucidating interactions between bacteria and a host, preferably lactic acid bacteria and a host, more preferably lactobacilli and a host, in particular for determining factors accounting for the probiotic properties of such strains.

In the context of this application the terms genome or genomic sequence shall be understood to mean the sequence of the chromosome of *Lactobacillus johnsonii*. The terms nucleotide sequence, polynucleotide or nucleic acid shall designate a double-stranded DNA, a single-stranded DNA or transcriptional products of the said DNAs of various length including oligo-nucleotides of about 5 to 200, preferably 10 to 100 nucleotides in length.

DETAILED DESCRIPTION OF THE PREFERRED EMBODIMENTS

According to the present invention a homologous nucleotide sequence is understood to mean a nucleotide sequence having a percentual identity with the sequence of SEQ ID. No. 1 (or selected parts thereof) of at least 90%, preferably at least 95%, more preferably 96% and even more preferably at least 98%. The said homologous may comprise, e.g., sequences corresponding to the genomic sequence or to the sequences of fragments thereof belonging to the species *Lactobacillus*, more preferably to the species *Lactobacillus johnsonii*, as well as the sequences corresponding to the genomic sequence or to the sequences of its representative fragments of a bacterium belonging to related species. In the present invention, the terms species and genus are mutually interchangeable.

These homologous sequences may thus correspond to variations linked to mutations within the same species or between species and may correspond in particular to truncations, substitutions, deletions and/or additions of at least one nucleotide. The said homologous sequences may also correspond to variations linked to the degeneracy of the genetic code or to a bias in the genetic code which is specific to the family, to the species or to the variant and which are likely to be present in *Lactobacillus*.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (see e.g. Pearson and Lipman, 1988, Proc. Natl. Acad. Sci. USA 85 (8): 2444-2448; Altschul et al., 1990, J. Mol. Biol. 215 (3): 403-410; Thompson et al., 1994, Nucleic Acids Res. 22 (2): 4673-4680; Higgins et al., 1996, Methods Enzymol. 266: 383-402; Altschul et al., 1990, J. Mol. Biol. 215 (3): 403-410; Altschul et al., 1993, Nature Genetics 3: 266-272).

In a particularly preferred embodiment, protein and nucleic acid sequence homologies are evaluated using the Basic Local Alignment Search Tool ("BLAST") which is well known in the art (supra). In particular, four specific BLAST programs have been used to perform the following task:

(1) BLASTP: Compares an amino acid query sequence against a protein sequence database
(2) BLASTN: Compares a nucleotide query sequence against a nucleotide sequence database
(3) BLASTX: Compares a nucleotide query sequence translated in all reading frames against a protein sequence database
(4) TBLASTN: Compares a protein query sequence against a nucleotide sequence database dynamically translated in all reading frames Among these representative fragments, those capable of hybridizing under stringent conditions with a nucleotide sequence disclosed in the present invention are preferred. Hybridization under stringent conditions means that the temperature and ionic strength conditions are chosen such that they allow hybridization to be maintained between two complementary DNA fragments. Such conditions of high stringency may e.g. be achieved by carrying out the hybridisation at a preferred temperature of 65° C. in the presence of SSC buffer, e.g. 1×SSC corresponding to 0.15 M NaCl and 0.05 M Na-citrate. The washing steps may be, for example, the following: 2×SSC, 0.1% SDS at room temperature followed by three washes with 1×SSC, 0.1% SDS; 0.5×SSC, 0.1% SDS; 0.1×SSC, 0.1% SDS at 68 C for 15 minutes.

The nucleotide sequences SEQ. ID. NO. 1 has been obtained by sequencing the genome of *Lactobacillus johnsonii* La1 by the method of directed sequencing after fluorescent automated sequencing of the inserts of clones and assembling of these sequences of nucleotide fragments (inserts) by means of software. To this end, fragments of the genome were created, ligated into suitable vectors for amplification and propagation and the corresponding fragments were sequenced. Overlaps and the final arrangement of the fragments, the nucleotide sequence thereof, were assessed by the aid of appropriate softwares.

Clones for sequencing also included 10'000 bp plus fragments as BAC clones that were used to provide a larger scale framework to the assembly. Due to the presence of several repeated regions a correct assembly proved extremely difficult. These included especially the repeated regions such as IS elements, the ribosomal operons and specifically the genes for two large cell surface proteins that contain between 100 and 200 almost perfect 10 amino acid repeats. In this case the exact sequence of these regions could not be determined due to the inability of current DNA sequencing techniques to cover the region in one run. Internal sequencing primers are excluded as they prime at multiple sites within the gene. Also, the relative orientation of these two genes, their long and very high sequence similarity makes them potential targets for host recombination. While the topology presented here has been confirmed by PCR with appropriate primers, the genome is very probably a product of such a recombination event as implied by the relative positions of the origin and termination of replication. A second problem encountered with the ribosomal operon repeats is that the presence of 6 operons at only 4 loci had been identified, and the exact location of their positions of the extra loci was only difficult to achieve. Finally, two of the IS elements are present in multiple copies, and depending on their replative orientations, they may be targets for host recombination. Such an event has been identified by studying the sequences flanking the IS element, and specifically the chromosomal target sequence that is duplicated on transposition, and hence each IS element should be flanked by identical direct repeats. We have identified two IS elements where the direct repeats have been switched due to host recombination within the IS elements. This produces an approximately 600'000 bp inversion that has been confirmed by PCR with specific primers. This IS element specific recombination may be a dynamic event that is taking place within a growing culture, leading to a major species plus a small presence of the recombined genome (seen as a faint PCR band). Finally we have the case of the prophage L771 (approximately 40'000 bp) that is constantly being excised by a site-specific recombinase. We have developed a quantitative PCR technique to detect the presence and measure the relative abundance of each variant. No pure cultures have been prepared to date.

Particularly preferred fragments of the nucleic acid sequence as identified by SEQ. ID. No. 1 are from 1-54596, from 56070-77430, from 81302-308537, from 309588-342757, from 378458-389217, from 389779-404510, from 405561-501116, from 503873-558194, from 563262-696518, from 697569-721736, from 722787-756845, from 761682-860446, from 860723-865550, from 867260-867490, from 868541-1448288, from 1463851-1526077, from 1527278-1552024, from 1563147-1809115, from 1810166-1858190, from 1863258-1872871, from 1877939-1930430, from 1932063-1983043, based on the numbering of SEQ ID. No. 1, each.

The present invention may also be utilized for producing polypeptides by using the knowledge of open reading frames (ORFs) as derived from SEQ. ID. NO. 1 and expressing the polypeptide desired according to well known techniques. In this respect, a nucleic acid corresponding to an open reading frame may be selected and inserted into an expression vector. The vector may then be introduced into a host, that enables transcription and translation of the open reading frame into the polypeptide under suitable conditions.

Nucleic acid molecules derived from the genomic sequence as identified by SEQ. ID. NO. 1 may easily be obtained, by e.g. specific amplification of the corresponding sequence using the polymerase chain reaction. Due to the sequence information provided herein the skilled person may design and synthesize any suitable primer nucleotide and amplify a fragment of interest using the polymerase chain reaction. Therefore, the present invention also comprises nucleotide sequences selected from sequence SEQ. ID. NO. 1 which can be used as a primer for the amplification of nucleic acid sequences. Other techniques for amplifying the target nucleic acid may of course also be used, such as e.g. the TAS (Transcription-based Amplification System) technique, the 3SR (Self-Sustained Sequence Replication) technique, the NASBA (Nucleic Acid Sequence Based Amplification) technique, the SDA (Strand Displacement Amplification) technique or the TMA (Transcription Mediated Amplification) technique etc.

The (poly)nucleotides may be used as probes and techniques for amplifying or modifying a nucleic acid serving as a probe, such as e.g. the LCR (Ligase Chain Reaction) technique, the RCR (Repair Chain Reaction) technique, the CPR (Cycling Probe Reaction) technique or the Q-beta-replicase amplification technique may well be applied.

The present invention, therefore, envisages both hybridization (detection) probes and primers for detecting a nucleotide sequence (target nucleotide) of the present invention. In the case of the target being a RNA molecule, e.g. a mRNA, said mRNA may be directly detected or transformed to a cDNA prior to detection.

Alternatively, in order to obtain fragments of the nucleic acid represented by SEQ. ID. NO. 1 the *Lactobacillus johnsonii* genomic DNA may be subjected to digestion with selected restriction enzymes, with the fragments being separated by e.g. electrophoresis or another suitable separation technique. Such techniques are well known in the art and are inter alia disclosed in Sambrook et al. A Laboratory Manual, Cold Spring Harbor, 1992. Such fragments may easily be obtained by isolating the genomic DNA of *Lactobacillus johnsonii* La1 and performing the necessary steps.

In an alternative form the nucleic acids may also be obtained by chemical synthesis when they are not too large in size according to methods well known to a person skilled in the art.

Modified nucleotide sequences shall be understood to mean any nucleotide sequence obtained by mutagenesis according to techniques well known to a skilled person and exhibiting modifications in relation to the normal sequences, for example mutations in the regulatory and/or promoter sequences for the expression of a polypeptide, in particular leading to a modification of the level of expression of the said polypeptide or to a modulation of the replicative cycle. Modified nucleotide sequence will also be understood to mean any nucleotide sequence encoding a modified polypeptide as defined herein.

During the study of the *Lactobacillus johnsonii* genome the following open reading frames could be determined with an annotation of the function of the resulting polypeptide being possible on the basis of homology to known proteins.

TABLE I

| Gene | Start | Stop | Complement* | % ID | Function |
|---|---|---|---|---|---|
| LJ_0008 (78 aa*) | 9756 | 9992 | | 84.8 | Ribosomal protein S18 |
| LJ_0043 (384 aa) | 52848 | 54002 | complement | 76.4 | INOSINE-5'-MONOPHOSPHATE DEHYDROGENASE (EC 1.1.1.205) |
| LJ_0045 (337 aa) | 54728 | 55741 | complement | 96.7 | D-lactate dehydrogenase (EC 1.1.1.28) |
| LJ_0054 (304 aa) | 75671 | 76585 | | 93 | Prolinase prolyl aminopeptidase (EC 3.4.11.5) |
| LJ_0056 (316 aa) | 77465 | 78415 | complement | 99 | Conjugated bile salt hydrolase (EC 3.5.1.24) |
| LJ_0057 (451 aa) | 78431 | 79786 | complement | 88 | Putative bile salt transporter |
| LJ_0058 (452 aa) | 79810 | 81168 | complement | 81.4 | Putative bile salt transporter |
| LJ_0065 (235 aa) | 87816 | 88523 | | 74.6 | Response regulator |
| LJ_0124 (149 aa) | 146032 | 146481 | complement | 80.4 | Nucleoside deoxyribosyltransferase-II (EC 2.4.2.6) |
| LJ_0178 (436 aa) | 211269 | 212579 | complement | 71.1 | Aminopeptidase G (EC 3.4.22.-) |
| LJ_0182 (482 aa) | 214451 | 215899 | complement | 98.7 | 6-PHOSPHO-BETA-GLUCOSIDASE (EC 3.2.1.86) |
| LJ_0215 (367 aa) | 248929 | 250032 | | 70.2 | Multiple sugar-binding transport ATP-binding protein msmK. (EC 2.7.1.69) |
| LJ_0229 (517 aa) | 264155 | 265708 | | 75.2 | GMP synthase [glutamine-hydrolyzing] (EC 6.3.5.2) |
| LJ_0258 (471 aa) | 287474 | 288889 | complement | 85.9 | Dipeptidase A (EC 3.4.*.*) |
| LJ_0260 (653 aa) | 290018 | 291979 | | 75 | Raffinose carrier protein (RAFFINOSE PERMEASE) |
| LJ_0262 (480 aa) | 294170 | 295612 | | 71.6 | sucrose phosphorylase (EC 2.4.1.7) |
| LJ_0274 (323 aa) | 307454 | 308425 | complement | 84.4 | L-lactate dehydrogenase (EC 1.1.1.27) |
| LJ_0295 (249 aa) | 332973 | 333722 | | 79.7 | ORF 169a (prophage protein) |
| LJ_0307 (284 aa) | 343364 | 344218 | | 100 | terminase small subunit (prophage protein) |
| LJ_0308 (424 aa) | 344205 | 345479 | | 100 | orf345; terminase large subunit (prophage protein) |
| LJ_0309 (499 aa) | 345495 | 346994 | | 99.7 | orf500; putative portal protein (prophage protein) |
| LJ_0311 (360 aa) | 347218 | 348300 | | 100 | orf360; putative minor head protein (prophage protein) |
| LJ_0312 (214 aa) | 348455 | 349099 | | 100 | orf214; scaffold protein (prophage protein) |
| LJ_0313 (121 aa) | 349112 | 349477 | | 100 | Orf121 (prophage protein) |
| LJ_0314 (349 aa) | 349498 | 350547 | | 100 | orf349; major head protein (prophage protein) |
| LJ_0315 (105 aa) | 350557 | 350874 | | 99 | Orf105 (prophage protein) |
| LJ_0316 (117 aa) | 350871 | 351224 | | 100 | Orf117 (prophage protein) |
| LJ_0317 (182 aa) | 351217 | 351765 | | 99 | Orf106 (prophage protein) |
| LJ_0318 (122 aa) | 351766 | 352134 | | 100 | Orf122 (prophage protein) |
| LJ_0319 (159 aa) | 352137 | 352616 | | 100 | orf159; putative major tail protein (prophage protein) |
| LJ_0320 (136 aa) | 352694 | 353104 | | 93.3 | Orf136 (prophage protein) |
| LJ_0321 (97 aa) | 353197 | 353490 | | 100 | Orf109 (prophage protein) |
| LJ_0322 (2021 aa) | 353490 | 359555 | | 92.6 | orf1434; putative minor tail protein (prophage protein) |
| LJ_0323 (118 aa) | 359573 | 359929 | | 99 | Orf109a (prophage protein) |
| LJ_0324 (1624 aa) | 359943 | 364817 | | 100 | Orf977 (prophage protein) |
| LJ_0325 (86 aa) | 364949 | 365209 | | 100 | Orf86 (prophage protein) |
| LJ_0326 (135 aa) | 365209 | 365616 | | 100 | Orf135 (prophage protein) |
| LJ_0327 (85 aa) | 365626 | 365883 | | 88.2 | Orf85 (prophage protein) |
| LJ_0328 (115 aa) | 365876 | 366223 | | 100 | orf115; putative holin (prophage protein) |
| LJ_0329 (310 aa) | 366216 | 367148 | | 99.6 | orf376; lysin (prophage protein) |
| LJ_0332 (1209 aa) | 370820 | 374449 | | 70.9 | rpoB; RNA polymerase (beta subunit) (EC 2.7.7.6) |
| LJ_0333 (1224 aa) | 374470 | 378144 | | 70 | rpoC; RNA polymerase (beta subunit) (EC 2.7.7.6) |
| LJ_0335 (135 aa) | 379054 | 379461 | | 85.8 | RS12; ribosomal protein S12 |
| LJ_0336 (156 aa) | 379485 | 379955 | | 76.7 | RS7; 30S ribosomal protein S7 |

TABLE I-continued

| Gene | Start | Stop | Complement* | % ID | Function |
|---|---|---|---|---|---|
| LJ_0337 (698 aa) | 379985 | 382081 | | 70.7 | translation elongation factor G, EF-G |
| LJ_0339 (209 aa) | 382686 | 383315 | | 73.4 | rplC; 50S ribosomal protein L3 |
| LJ_0342 (278 aa) | 384263 | 385099 | | 75.1 | rplB; 50S ribosomal protein L2 |
| LJ_0343 (95 aa) | 385121 | 385408 | | 81.1 | rpsS; 30S ribosomal protein S19 |
| LJ_0344 (117 aa) | 385429 | 385782 | | 75.4 | rplV; ribosomal protein L22 |
| LJ_0345 (222 aa) | 385800 | 386468 | | 70 | 30S ribosomal protein S3 |
| LJ_0346 (145 aa) | 386468 | 386905 | | 84.8 | ribosomal protein L16 |
| LJ_0347 (88 aa) | 387118 | 387384 | | 72 | 30S RIBOSOMAL PROTEIN S17 |
| LJ_0348 (122 aa) | 387415 | 387783 | | 72.9 | rplN; ribosomal protein L14 |
| LJ_0350 (180 aa) | 388058 | 388600 | | 79.7 | RL5; ribosomal protein L5 (BL6) |
| LJ_0351 (132 aa) | 388825 | 389223 | | 70.4 | rpsH; 30S Ribosomal protein S8 |
| LJ_0352 (176 aa) | 389248 | 389778 | | 98.2 | lecLA2-20; lectin-like protein LA2-20 |
| LJ_0353 (119 aa) | 389806 | 390165 | | 72.2 | rplR; 50S ribosomal protein L18 |
| LJ_0358 (73 aa) | 393402 | 393623 | | 84.5 | Translation initiation factor IF-1 |
| LJ_0359 (115 aa) | 393788 | 394135 | | 73.6 | rpsM; ribosomal protein S13 |
| LJ_0360 (129 aa) | 394160 | 394549 | | 73 | rpsK; 30S Ribosomal protein S11 |
| LJ_0362 (127 aa) | 395560 | 395943 | | 73.2 | rplQ; 50S Ribosomal protein L17 |
| LJ_0368 (131 aa) | 399970 | 400365 | | 70 | 30S RIBOSOMAL PROTEIN S9 |
| LJ_0395 (449 aa) | 441168 | 442517 | complement | 81.5 | Aminopeptidase C (EC 3.4.22.40) |
| LJ_0399 (499 aa) | 445878 | 447377 | | 73.5 | Glutamyl-tRNA synthetase (EC 6.1.1.17) |
| LJ_0410 | 458506 | 458931 | | 77 | 50S ribosomal protein L11 |
| LJ_0441 (330 aa) | 483735 | 484727 | complement | 70.6 | GMP reductase (EC 1.6.6.8) |
| LJ_0460 (94 aa) | 501772 | 502056 | | 99 | GroES chaperone |
| LJ_0461 (543 aa) | 502087 | 503718 | | 99 | GroEL chaperone |
| LJ_0490 (368 aa) | 543751 | 544857 | complement | 75.2 | pepQ; Xaa-Pro dipeptidase (EC 3.4.13.9) |
| LJ_0493 (465 aa) | 548984 | 550341 | complement | 71.6 | pepV; Xaa-His dipeptidase (EC 3.4.13.3) |
| LJ_0505 (309 aa) | 565393 | 566322 | | 73.1 | Mannose-specific phosphotransferase system comp. IID (EC 2.7.1.69) |
| LJ_0521 (536 aa) | 583645 | 585255 | | 79 | Putative ABC transporter |
| LJ_0563 (228 aa) | 623532 | 624218 | | 83.7 | putative response regulator |
| LJ_0631 (158 aa) | 705767 | 706243 | complement | 74 | Autoinducer protein luxS |
| LJ_0677 (402 aa) | 762315 | 763523 | | 70 | metK; S-adenosylmethionine synthetase (EC 2.5.1.6) |
| LJ_0764 (435 aa) | 859739 | 861046 | | 100 | putative sensor histidine kinase |
| LJ_0767 (719 aa) | 863354 | 865513 | | 77.9 | Sequence from patent |
| LJ_0768 (197 aa) | 865524 | 866117 | | 91.4 | Lacticin F transporter accesory protein |
| LJ_0769 (75 aa) | 866244 | 866471 | | 98.6 | Bacteriocin lactacin F, subunit lafA precursor |
| LJ_770 (62 aa) | 866485 | 866671 | | 100 | Bacteriocin lacticin F, subunit lafX precursor |
| LJ_0771 (124 aa) | 866757 | 867131 | | 90.3 | Bacteriocin lacticin F immunity protein, lafI |
| LJ_0775 (719 na) | 869095 | 871254 | | 77.9 | Sequence from patent |
| LJ_0776 (197 aa) | 871265 | 871858 | | 77.1 | Hypothetical protein |
| LJ_0817 (88 aa) | 910392 | 910658 | | 79.5 | Phosphocarrier protein HPr |
| LJ_0827 (591 aa) | 918499 | 920274 | | 71 | Sequence from patent |
| LJ_0840 (360 aa) | 932899 | 933981 | | 72 | recA; Recombinase A |
| LJ_0846 (181 aa) | 939718 | 940263 | | 80.1 | Hypothetical protein |
| LJ_0847 (799 aa) | 940421 | 942820 | | 81.9 | preprotein translocase SecA subunit |
| LJ_0848 (332 aa) | 943020 | 944018 | | 72.5 | peptide chain release factor 2 |
| LJ_0853 (311 aa) | 947228 | 948163 | | 71.8 | trxB; THIOREDOXIN REDUCTASE (EC 1.6.4.5) |
| LJ_0855 (317 aa) | 949277 | 950230 | complement | 71 | lacM; Beta-galactosidase small subunit (EC 3.2.1.23) |
| LJ_0856 (626 na) | 950211 | 952091 | complement | 75.2 | lacL; Beta-galactosidase large subunit (EC 3.2.1.23) |
| LJ_0860 (389 aa) | 957611 | 958780 | | 76.8 | galK; Galactokinase (EC 2.7.1.6) (Galactose kinase) |
| LJ_0861 (495 aa) | 958799 | 960286 | | 74.7 | galT; Galactose-1-phosphate uridylyltransferase (EC 2.7.7.10) |
| LJ_0864 (671 aa) | 963226 | 965241 | | 76.9 | uvrB; EXCINUCLEASE ABC SUBUNIT B |
| LJ_0870 (195 aa) | 971745 | 972332 | complement | 70 | clpP, ATP-dependent Clp protease proteolytic subunit (EC 3.4.21.92) |
| LJ_0873 (338 aa) | 975442 | 976458 | | 87.8 | gapdh; Glyceraldehyde 3-phosphate dehydrogenase (EC 1.2.1.12) |
| LJ_0874 (403 aa) | 976565 | 977776 | | 84.3 | pgk; Phosphoglycerate kinase (EC 2.7.2.3) |
| LJ_0875 (251 aa) | 977795 | 978550 | | 84.8 | tim; Triosephosphate isomerase (EC 5.3.1.1) |
| LJ_0876 | 978600 | 979898 | | 71 | Enolase (EC 4.2.1.11) (2-phosphoglycerate dehydratase) |
| LJ_0925 (447 aa) | 1023089 | 1024432 | | 72.5 | Glucose-6-phosphate isomerase (EC 5.3.1.9) |
| LJ_0934 (203 aa) | 1032968 | 1033579 | | 73.7 | uracil phosphoribosyltransferase (EC 2.4.2.9) |
| LJ_0936 (70 aa) | 1034425 | 1034637 | | 73.9 | atpE; F1F0-ATPase subunit c (EC 3.6.1.34) |
| LJ_0937 (166 aa) | 1034690 | 1035190 | | 70 | atpF, F1F0-ATPase subunit b (EC 3.6.1.34) |
| LJ_0939 (503 aa) | 1035750 | 1037261 | | 84.8 | atpA; F1F0-ATPase subunit alpha (EC 3.6.1.34) |
| LJ_0941 (480 aa) | 1038258 | 1039700 | | 84.7 | atpD; F1F0-ATPase subunit beta (EC 3.6.1.34) |
| LJ_0954 (384 aa) | 1049212 | 1050366 | | 70.8 | nifS; pyridoxal-phosphate dependent aminotransferase (EC 4.4.1.-) |
| LJ_0976 (458 aa) | 1074934 | 1076310 | | 73 | CELL DIVISION PROTEIN FTSZ |
| LJ_0996 (618 aa) | 1093985 | 1095841 | | 70 | elongation factor Tu family protein |
| LJ_1007 (89 aa) | 1103999 | 1104268 | | 71.9 | rpsO; 30S ribosomal protein S15 |
| LJ_1010 (396 aa) | 1107239 | 1108429 | | 74 | EF-Tu; Elongation factor Tu |
| LJ_1033 (372 aa) | 1129276 | 1130394 | | 85.8 | Sequence from patent |
| LJ_1079 (319 aa) | 1181384 | 1182343 | | 76.1 | K6PF; 6-phosphofructokinase (EC 2.7.1.11) |
| LJ_1080 (589 aa) | 1182378 | 1184147 | | 83 | pyk; Pyruvate kinase (EC 2.7.1.40) |
| LJ_1092 (91 aa) | 1193710 | 1193985 | | 77.5 | hu; DNA-binding protein II |
| LJ_1111 (174 aa) | 1215382 | 1215906 | | 83.9 | hslU; heat shock induced protein HtpI |
| LJ_1112 (464 aa) | 1215917 | 1217311 | | 76.1 | HSLU; ATP-dependent hsl protease ATP-binding subunit hslU. |
| LJ_1138 264 aa) | 1255582 | 1256376 | | 70 | ABC transporter ATP-binding protein |
| LJ_1170 (661 aa) | 1287817 | 1289802 | | 71 | topoisomerase IV B subunit (EC 5.99.1.*) |

TABLE I-continued

| Gene | Start | Stop | Complement* | % ID | Function |
|---|---|---|---|---|---|
| LJ_1200 (432 aa) | 1324275 | 1325573 | complement | 83.5 | asnA1; Asparaginyl-tRNA synthetase (EC 6.1.1.22) |
| LJ_1207 (357 aa) | 1338065 | 1339138 | | 70.1 | pmk; phosphomevalonate kinase (EC 2.7.1.36) |
| LJ_1298 (75 aa) | 1425244 | 1425471 | | 71.8 | tpnA; transposase, fragment only |
| LJ_1303 (415 aa) | 1428575 | 1429822 | complement | 85.4 | pepT, PEPTIDASE T (EC 3.4.11.-) (aminotripeptidase) (tripeptidase) |
| LJ_1304 (265 aa) | 1429834 | 1430631 | complement | 81.1 | Hypothetical protein |
| LJ_1317 (372 aa) | 1441016 | 1442134 | complement | 81.4 | rpoD; RNA polymerase sigma factor rpoD (Sigma-42) |
| LJ_1320 (305 aa) | 1446050 | 1446967 | complement | 70.4 | glyQ; Glycyl-tRNA synthetase alpha chain (EC 6.1.1.14) |
| LJ_1389 (142 aa) | 1457128 | 1457556 | complement | 71.7 | Peptide methionine sulfoxide reductase (EC 1.8.4.6) |
| LJ_1356 (326 aa) | 1484903 | 1485883 | complement | 99 | conjugated bile salt hydrolase bile (EC 3.5.1.24) |
| LJ_1384 (470 aa) | 1510322 | 1511734 | complement | 100 | orf338; putative portal protein (prophage protein) |
| LJ_1385 (422 aa) | 1511746 | 1513014 | complement | 100 | orf42; terminase large subunit (prophage protein) |
| LJ_1386 (151 aa) | 1513007 | 1513462 | complement | 100 | orf155; terminase small subunit (prophage protein) |
| LJ_1387 (218 aa) | 1513519 | 1514175 | complement | 100 | Orf221 (prophage protein) |
| LJ_1388 (174 aa) | 1514357 | 1514881 | complement | 90.5 | Orf174 (prophage protein) |
| LJ_1389 (146 aa) | 1515925 | 1516365 | complement | 100 | Orf154 (prophage protein) |
| LJ_1390 (73 aa) | 1516454 | 1516675 | complement | 100 | Orf85 (prophage protein) |
| LJ_1391 (184 aa) | 1516695 | 1517249 | complement | 93.4 | Orf197 (prophage protein) |
| LJ_1392 (132 aa) | 1517251 | 1517649 | complement | 82.6 | Orf79 (prophage protein) |
| LJ_1393 (71 aa) | 1517650 | 1517865 | complement | 96.5 | Orf78a (prophage protein) |
| LJ_1394 (296 aa) | 1518025 | 1518915 | complement | 98.1 | Orf212 (prophage protein) |
| LJ_1395 (261 aa) | 1518928 | 1519713 | complement | 93.9 | Orf223 (prophage protein) |
| LJ_1396 (297 aa) | 1519715 | 1520608 | complement | 100 | Orf309 (prophage protein) |
| LJ_1397 (71 aa) | 1521285 | 1521500 | complement | 100 | Orf73 (prophage protein) |
| LJ_1415 (318 aa) | 1534064 | 1535020 | complement | 71.4 | thyA; thymidylate synthase (EC 2.1.1.45) |
| LJ_1423 (624 aa) | 1545410 | 1547284 | complement | 85.3 | dnaK; heat shock protein DnaK |
| LJ_1431 (880 aa) | 1553796 | 1556438 | complement | 70.3 | IF2; Translation initiation factor IF-2. |
| LJ_1442 (241 aa) | 1568288 | 1569013 | complement | 70.5 | pyrH; UMP-kinase (EC 2.7.4.-) |
| LJ_1444 (261 aa) | 1570186 | 1570971 | complement | 75.6 | RS2; 30S ribosomal protein S2. |
| LJ_1446 (125 aa) | 1581060 | 1581437 | complement | 76.1 | RL19; 50S ribosomal protein L19. |
| LJ_1447 (84 aa) | 1605746 | 1606000 | | 80 | RL28; 50S ribosomal protein L28. |
| LJ_1429 (794 aa) | 1656725 | 1659109 | | 71.5 | pepX; Xaa-Pro dipeptidyl-peptidase (EC 3.4.14.11) |
| LJ_1537 (301 aa) | 1666162 | 1667067 | complement | 71.2 | galU; UDP-glucose pyrophosphorylase, (EC 2.7.7.9) |
| LJ_1558 (445 aa) | 1686863 | 1688200 | complement | 72.8 | Glutamine synthetase (EC 6.3.1.2) (Glutamate--ammonia ligase) |
| LJ_1584 (118 aa) | 1713330 | 1713686 | complement | 70.7 | RL20; 50S ribosomal protein L20 |
| LJ_1681 (128 aa) | 1826901 | 1827287 | | 72.6 | tagD; Glycerol-3-phosphate cytidylyltransferase (EC 2.7.7.39) |
| LJ_1741 (215 aa) | 1902945 | 1903592 | complement | 72.5 | Pyrrolidone-carboxylate peptidase (EC 3.4.19.3) |
| LJ_1767 (215 aa) | 1930610 | 1931257 | | 100 | deoxyadenosine kinase (EC 2.7.1.76) |
| LJ_1768 (224 aa) | 1931279 | 1931953 | | 99.1 | deoxyguanosine kinase (EC 2.7.1.113) |

*complement = on the reverse strand
*aa = amino acids

The ORFs corresponding to various polypeptides are shown in table 1, supra, and are represented by their position in the genomic sequence as identified by SEQ. ID. NO. 1.

The open reading frames have been identified via homology analyses as well as via analyses of potential ORF start sites. It is to be understood that each identified ORF comprises a nucleotide sequence that spans the contiguous nucleotide sequence from the codon immediately 3' to the stop codon of the preceding ORF and through the 5' codon to the next stop codon of SEQ. ID. NO. 1 in frame to the ORF nucleotide sequence.

Table 1 also depicts the results of homology searches that compared the sequences of the polypeptides encoded by each of the ORFs to sequences present in databases.

The sequence information disclosed in the present application may be utilized for selecting a polynucleotide of interest, i.e. a nucleic acid containing an open reading frame encoding a known or an unknown, putative polypeptide and transforming micro-organisms with the selected polynucleotide. As transformation vehicles the well known plasmids, phage vectors (transfection) or F-vectors (conjugation) may be utilized. The nucleic acid introduced into the micro-organism selected may be expressed and its biological function may be either utilized as such, if known, or elucidated, in case a so far unknown polypeptide is expressed. The micro-organism selected may be a *Lactobacillus* itself or other well known micro-organisms, such as bacteria, e.g. *E. coli, Streptococci* or yeast, insect cells or even animal and plant cells.

It will be understood that the polypeptides may be expressed as such or as a fusion polypeptide. The skilled person is well aquatinted with techniques performing such a ligation and expressing the corresponding fusion-polypeptide in an appropriate cell.

In view of the present invention also new recombinant vectors for the cloning and/or the expression of a nucleotide sequence according to the present invention may be devised. The vectors comprise elements necessary to enable expression and/or secretion of the nucleotide sequences in a given host cell, such as a promoter, signals for initiation and for termination of translation, as well as appropriate regions for regulation of transcription. For example, expression of a protein or peptide may be controlled by any promoter/enhancer element known in the art. Exemplary promotors are the CMV promoter, the SV40 early promoter region, the promoter contained in the 3' long terminal repeat of the rous sarcoma virus, the herpes thymidine kinase promoter, the regulatory sequences of the metallothionein gene, or, for prokaryotic expression systems, the β-lactamase promoter, the tac promoter or the T7 promoter.

The vector should be capable of being stably maintained in the host cell and may optionally possess particular signals specifying the secretion of the translated protein. These different elements are chosen according to the host cell utilized. To this effect the nucleotide sequences according to the invention may be inserted into autonomously-replicating vectors within the chosen host, or integrative vectors in the chosen host, such as e.g. yeast artificial chromosomes, plasmids or viral vectors.

Any of the standard methods known to those skilled in the art for inserting DNA fragments into a vector may be used to construct expression vectors containing a chimeric gene consisting of appropriate transcriptional/translational control signals and the protein coding sequences. These methods may include in vitro recombinant DNA and synthetic techniques and in vivo recombinants (genetic recombination).

The vector may be used for transcription and/or translation of a nucleic acid comprised in SEQ. ID. NO. 1, to produce RNA or antisense RNA, respectively. Such a vector can remain episomal or become chromosomally integrated, as long as it can be transcribed to produce the desired transcript.

The antisense nucleic acids of the invention comprise a sequence complementary to at least a portion of a RNA transcript of a polynucleotide sequence in SEQ. ID. NO. 1, designating a sequence having sufficient complementarity to be able to hybridize with the RNA, forming a stable duplex. In the case of double-stranded antisense nucleic acid sequence, a single strand of the duplex DNA may thus be tested, or triplex formation may be assayed.

In knowledge of the present invention also host cells may be obtained transformed with a nucleic acid or a vector according described herein. These cells may be attained by introducing into an appropriate cell a nucleotide sequence or a vector as defined above, and then culturing the said cell under conditions allowing the replication and/or the expression of the transformed/transfected nucleotide sequence.

The host cell may be chosen from eukaryotic or prokaryotic system, such as for example bacterial cells, yeast cells, animal cells as well as plant cells. In the context of this invention a cell shall be understood to comprise higher biological systems. Such as animals, whole plants or parts thereof.

Furthermore, a host cell strain may be chosen which modulates the expression of the inserted sequences, or modifies and processes the gene product in the specific fashion desired.

A preferred host cell for the expression of the proteins of the invention consists of prokaryotic cells, such as gram negative or gram positive bacteria. A further preferred host cell according to the invention is a bacterium belonging to the *Lactobacillus* family, more preferably belonging to the species *Lactobacillus johnsonii* or chosen from a microorganism associated with the species *Lactobacillus*.

The transformed/transfected cells according to the invention may advantageously serve as a model and may be used in methods for studying, identifying and/or selecting compounds capable of being responsible for any of the beneficial effects brought about by the present *Lactobacillus* strain.

The invention further enables the synthesis of polypeptides encoded by the *Lactobacillus johnsonii* ORFs, in particular those listed in table 1. In the present description, the terms polypeptide, peptide and protein are used interchangeably. Furthermore the present invention also enables to carry out method for preparing such polypeptides by recombinant means comprising the steps of (a) culturing a host cell according to the present invention under conditions suitable to produce the polypeptide encoded by the polynucleotide; and (b) recovering the polypeptide from the culture.

It will be appreciated that the above polypeptides may also be obtained using combinatory chemistry, wherein the polypeptide is modified at some locations before testing them in model systems, so as to select the compounds which are the most active or which exhibit the desired properties.

In this context, chemical synthesis has the advantage of being able to use non-natural amino acids or non-peptide bonds. Accordingly, in order to e.g. extend the life of the polypeptides according to the invention, it may be advantageous to use such non-natural amino acids, for example in the D form, or alternatively amino acid analogues, preferably sulphur-containing forms.

Finally, the structure of the polypeptides according to the invention, its homologous or modified forms, as well as the corresponding fragments may be integrated into chemical structures of the polypeptide type and the like. Accordingly, in order to preserve the polypeptide in an in vivo environment it will be preferred to provide at the N- and C-terminal ends compounds which convey a resistance to degradation to proteases.

It will also be appreciated that the different polypeptides according to the present invention and produced by the above method may represent antigens to the immune system of a host animal, so that antibodies may be produced directed against said polypeptides. These antibodies may be used for the detection of a polypeptide of interest in a mixture or generically of a strain of *Lactobacillus* in a sample. In addition they may be used as research tools by e.g. producing antibodies against cellular surface epitopes and determining the effect of blocking certain polypeptides on the bacterial cell wall.

According to another aspect the present invention also provides a method for the detection and/or identification of *Lactobacilli*, preferably *Lactobacillus johnsonii* in a biological sample. This method may comprise several techniques known in the art, such as PCR or simply hybridization with a suitable probe. Alternatively, an antibody raised against a cell wall epitope of *Lactobacillus*, preferably *Lactobacillus johnsonii* may be used for said purpose. It will be appreciated that the above method may also be reversed and the presence of antibodies against *Lactobacillus* may be determined by contacting the sample to be tested with a polypeptide of *Lactobacillus* under conditions to allow formation of immune complexes.

The polypeptides and antibodies obtainable in knowledge of the present invention and the nucleotide sequences described herein may be used in in vitro and/or in vivo methods for the detection and/or the identification of bacteria belonging to the species *Lactobacillus* in a biological sample (biological tissue or fluid) which is likely to contain them. These methods, depending on the specificity of the polypeptides, of the antibodies and of the nucleotide sequences described herein, which will be used, may detect and/or identify the bacterial variants belonging to the species *Lactobacillus* as well as associated microorganisms capable of being detected by the polypeptides, the antibodies and the nucleotide sequences according to the invention which will be chosen. It may, for example, be advantageous to choose a polypeptide, an antibody or a nucleotide sequence according to the invention, which is capable of detecting any bacterium of the *Lactobacillus* family by choosing a polypeptide, an antibody and/or a nucleotide sequence according to the invention which is specific to the family.

The sequences referred to herein SEQ ID. NO. 1 is listed in the attached sequence listings which is to be considered as part of the specification.

The invention also comprises the nucleotide sequences or polypeptides according to the invention covalently or non-covalently immobilized on a solid support. In the first case such a support may serve to capture, through specific hybridization, the target nucleic acid obtained from a biological sample to be tested. If necessary, the solid support is separated from the sample and the hybridization complex formed between the capture probe and the target nucleic acid is then detected by means of a second probe, called detection probe, labeled with an easily detectable element.

Such support may take the form of so-called DNA array or DNA chips, a multitude of molecular probes precisely organized or arrayed on a solid support, which will allow sequencing genes, studies of mutations contained therein and the expression of genes, and which are currently of interest given their very small size and their high capacity in terms of number of analyses.

The function of these arrays/chips is based on molecular probes, mainly oligonucleotides which are attached to a carrier having a size of generally a few square centimetres or more as desired. For an analysis the carrier (DNA array/chip) is coated with probes that are arranged at a predetermined location of the carrier. A sample containing fragments of a target nucleic acid to be analyzed, for example DNA or RNA or cDNA, that has been labeled beforehand, is subsequently contacted with the DNA array/chip leading to the formation, through hybridization, of a duplex. After a washing step, analysis of the surface of the chip allows the effective hybridization to be located by means of the signals emitted by the labels tagging the target. A hybridization fingerprint results from this analysis which, by appropriate computer processing, allows to retrieve information such as the expression of genes, the presence of specific fragments in the sample, the determination of sequences and the presence of mutations.

The hybridization between the probes of the invention, deposited or synthesized in situ on the DNA chips, and the sample to be analyzed, may, e.g. be determined by means of fluorescence, radioactivity or by electronic detection.

The nucleotide sequences according to the invention may be used in DNA arrays/chips to carry out analyses of the expression of the *Lactobacillus* genes. This analysis is based on DNA arrays/chips on which probes, chosen for their specificity to characterize a given gene, are present. The target sequences to be analyzed are labeled before being hybridized onto the chip. After washing the labeled compounds are detected and quantified, with the hybridization being carried out at least in duplicate. Comparative analyses of the signal intensities obtained with respect to the same probe for different samples and/or for different probes with the same sample, determine a differential transcription of RNA derived from the sample.

The DNA arrays/chips according to the present invention may also contain nucleotide probes specific for other microorganisms, which will enable a serial testing allowing rapid identification of the presence of a microorganism in a sample.

The principle of the DNA chip, as detailed above may also be used to produce protein chips on which the support has been coated with a polypeptide or an antibody according to the invention, or arrays thereof, in place of the DNA. These protein chips make it possible to analyze the biomolecular interactions (BIA) induced by the affinity capture of target analytes onto a support coated e.g. with proteins, by surface plasma resonance (SPR). The polypeptides or antibodies according to the invention, capable of specifically binding antibodies or polypeptides derived from the sample to be analyzed, may thus be used in protein chips for the detection and/or the identification of proteins in samples.

The present invention also relates to a computer readable medium having recorded thereon one or more nucleotide and/or a polypeptide sequences according to the invention. This medium may also comprise additional information extracted from the present invention, such as e.g. analogies with already known sequences and/or information relating to the nucleotide and/or polypeptide sequences of other microorganisms so as to facilitate the comparative analysis and the exploitation of the results obtained. Preferred media are e.g. magnetic, optical, electrical and hybrid media such as, for example, floppy disks, CD-ROMs or recording cassettes.

The invention also relates to kits or sets for the detection and/or the identification of bacteria belonging to the species *Lactobacillus johnsonii* or to associated microorganisms, which comprises, a polypeptide according to the invention, where appropriate, the reagents for constituting the medium appropriate for the immunological or specific reaction, the reagents allowing the detection of the antigen-antibody complexes produced by the immunological reaction between the polypeptide (s) of the invention and the antibodies which may be present in the biological sample, it being possible for these reagents also to carry a label, or to be capable of being recognized in turn by a labeled reagent, more particularly in the case where the polypeptide according to the invention is not labeled, a reference biological sample (negative control) free of antibodies recognized by a polypeptide according to the invention, a reference biological sample (positive control) containing a predetermined quantity of antibodies recognized by a polypeptide according to the invention.

The invention also relates to a kit or set for the detection and/or the identification of bacteria belonging to the species *Lactobacillus johnsonii* or to an associated microorganism, or for the detection and/or the identification of a microorganism, wherein the kit comprises a protein chip according to the invention.

SEQUENCE LISTING (1 sequence)

SEQ ID NO: 1 - DNA, 1983043 bp, Lactobacillus johnsonii
  misc_feature (1788207)..(1788207): n is a, c, g, or t
  misc_feature (1788238)..(1788238): n may be a, c, g or t
  misc_feature (1788240)..(1788240): n may be a, c, g or t
  misc_feature (1788252)..(1788252): n may be a, c, g or t
  misc_feature (1788269)..(1788269): n may be a, c, g or t
  misc_feature (1788279)..(1788279): n may be a, c, g or t
  misc_feature (1788282)..(1788282): n may be a, c, g or t
  misc_feature (1788284)..(1788284): n may be a, c, g or t
  misc_feature (1790068)..(1790068): n may be a, c, g or t
  misc_feature (1980697)..(1980697): n may be a, c, g or t
  misc_feature (1980698)..(1980698): n may be a, c, g or t
  misc_feature (1980699)..(1980699): n may be a, c, g or t
  misc_feature (1980700)..(1980700): n may be a, c, g or t
  misc_feature (1980701)..(1980706): n may be a, c, g or t
  misc_feature (1982537)..(1982546): n may be a, c, g or t
ttgtttgatctagataaattttggcaattttttaatgctgagatgaaaaaaagctacagcacggttgcctataatgcttggtttaaaaatactaaaccaatttcctttaataaaaagacaaaagaaatgataatcgctgttgaatcacccgttgcaaagggatactgggaaaagaacttagcttctcaactcattcaagaagcatatgcttatgccgacatggaaattcaacctaaatttgaagttgcaggtaaagaaggtcctgaacgtttagttacaccacaaccacgaattaaaactaatcaagaaatattagaaaatcgtagagatgaatttgctcaagaccttcaactaaatagtaagtatactttcgatacttttgttcaaggtgagggaaacaagctggcagcgggtgcagccttagcagtcgctgataatccgggaagtttttacaatcctttgtttatttttggtggagttggtttaggtaaaacccacttaatgcaagccattggacaccaaatgttggctgaaaaaccacatgcaaaagtggtttatattcagagtgaaactttcgtaaatgattttattaactcaataaaaaacaaaactcaggctgaatttcgtaataagtatcggaactgtgatctcctattagtagacgatattcaattcttttctaaaaaagagggaatccaggaggaattcttccatacttttgaaaccctttataatgatcaaaaacagattgttatgactagtgatcgtctaccaaccgaaattcctgaattatcagaacgtttagtttcacgctttgcttggggactacaagttgaaattacgcctccagatttagagactagaattgcgattttgcgaaaaaaggctgaaaccgatggcctagcaattgacgacagtacccttgactatattgcttcccaagttgataccaatattcgtgaactcgaaggagctttagttaaagttcaagcccatgcaacaattgagcgcgaagatattaatgttgacttagccaaagaggctctagctgacttaaagttggtacaaaaaaatagggggcttcaaatttctaagattcaagaagttgtggccaactatttccaaacctcaactactgaactaaagggtaagaagcgtgtaaaacaaattgttgttcctcgacaaattgcaatgtatttgtctcgtgagttaacagattctagtttgcctaaaattggacaggaatttggcggtaaggatcacacaactgtaatgcatgcttgcgataaaatttcgcgtgccttaaaaactgatgctgaaattaaagcagctgtgtatgatttaaaggctatgcttgaacactaaaagttaataacatgtggataacttttaactttgtccacatttattaaacatgcaaaagtgtgttttattcaggtgtttggctactttcccacagattccactggccctactactacttctaagtatttaaatatataattaaataaaacaacgtacatataatttcacaggaggtaaacgatgcagtttacaattaatcgtaatttattcctcgaaaacctaaataatgctatgcgtgcaatttcttcacgtgctactattccaatattaagtggtataaaacttacccttacagatgaaatgcttactttaaccggtagtgatactgacatttctattgaaattcaaatcccagtaaacgatgatttaattgttcaatctacgggatcgatcgttttaccagcacgatttttcagtgaaattgtaaaaaaattaccaggtaaagatttttcatttgaagtaaaagaaagttttcaaacgaaaattgtttctgaaaataccgaattcatgattaacggtttagatgcaaacaattatccacacttaccagaaatttctactgatgcatcattcaaaatttctggtaaaacatttagagaaattattaacgaaactgtttttgcagtcgctactcaagaaagtcgtccaactttaactggtgttaactttatcttcaacaattcatcaattaaagcagttgctaccgacagtcaccgactatctcaacgtcaaatttctctagaaaatggtcctcaaacaagtactgacttaattattcctggaaagagcttagtagaattatcccgaattatcggagaaagtgatcctgaaatcacagtaaatcctggtgaaaaccaagttttatttgaagttggaaacattgcattctattcacgtttacttgatggacaatatccagacactgatcgtttaattccaactgaatctacaacatcagttgaatttgaattaccagttttagctcgttctctcgaacgtgccagtcttcttactcacgaaagccgtaataatgtggttaagatgactcttgatgttcaaaatcaattagttaaactccaaggtgattcaccggaaataggaaatgtggaagaagaaattggctttaagaatcttgaaggagatggcttaactatttccttcaatcctgattatctaagagaagctttacgtgcctctattactgattccattattatgaactttacccagccgctaagaccatttacagtgataccggcaaaacaagatgttaatttcactcaattaatcacgccagttagaacattttaatttataaaaagagctacaaaagtagctctttttttcttgcattgtatttaaaagctaaatttaggctgattaagcgaattttcatccagttaagagtcatattaaattggaataaagcggcttaaaaaaggctacaatacgtcataaaattgaatttcacataaaaaaacggtataatgactaggtatgacaaggtaaatggggtgatattatcaaaaaattcacaattaagggagaatatattacgctggctcagtttttaaaagaagagagtgtgatatcttctggtggtcaagctaaatggtatctaaaagaaaatcctgttaagttgaacggtgaagtagaagatcgccgtggaaagaaaatacatcctggagatgtactgaacttggctggagaagagtatgaatttatttcagagtagccgatgtatcttgcaaactttgaattgaaagattttagaaattttgaagaactaaagataaattttgaccctcatgtaaatatttttattggtccaaacgcccaaggaaaaactaatttacttgaggcgatttattttttggccctaactcgatctcatcgaacaaatagcgataaagaattaattcgttttggaagtaaatttgcgggcttacaaggaaaagttcataaaagtcaattagaagtagagttaaaattacgtttaacaccaaacggaaaaaaagcttgggtaaatagactcgagcaaaagaagctttccgcttatgtaggacaaatgaatgcaattttgttttctcccgaagacctagccctggttaaaggagctccatcaattagaagacgttttatggatttagagtttgggcaaattaattcagaatatctatattttttaagtcagtatcgtcaggtactgcaacaaagaaacaattacttaaagcaattgagcataaaaaaggcaaatgatttagtttttttagatgtcttgtcagatcagcttgcaggaattgcagcggagataatttctagaagaatcaaatatattaaaaaacttaattcatatgctcaaagtgctcatagtgagattagtggtcaagctgaaaaattacagattttttatcgtccatcagttaaggaaattaccccagatgatgatgtagagaccatttatcaaaaagttattactagttataaaaaaaatcgtcctaatgaaattcgaaaggggactactttgagtggacctcatcgagatgacttggattttttgattaacgataaaaatgcccatgattttgcatctcagggacagcaacggacgatttctttaagtgtaaagttggctgaaattcaattagtacatgaactgacacaagagtatccaattttacttttagatgatgtaatgagcgaattagatcatcgaagacaaagtagtttactaaattatattcatggaaaaacgcaaacttttatcacaacaacagatttagaaggtatttcttgggaaatcgtgaaagaacctaaggtctatcacatttctgctggaacgatcagtacaaaggagagttaaatggcagaagataagagcaaggcagcattaaataaagctaaagattttgaaaagcgtgctgatacttataacgcaagtcaaattcaagttctaggcggacttgaagcagttagaaagcgcccaggtatgtacattggctcaactagtagccaaggcttacaccaccttgtttgggaaattattgataatagtattgacgaacgattagcaggatttgcgaccaagattgaaattactgttaatgaagatggcagtgttacagtccaagatgatggacgtggtattccggttgatattcaagctaaaacaggtcgtccagccctagaaactgtatttactgttttgcatgctggtggtaaattcggcggtggcggatataaagtatctggtggtcttcacggtgttggtgcttctgtagtaaacgccctctcaactaaacttgaggttactgttatgagggatggaaagaaatatgcaatttcttttgatcatggccgtgtagtaggagaaatgaagcaagtgggaactgtacctcttgaagaacatggaacaatcgttcgtttctatcctgatccagatatttttacagaaactacaactttcgacgataaaattttaaagaaccgaattcgtgaacttgctttcttaaacaagggcttaaaattaacctttaccgataagcgtaaagaaagtgctgaaactgatgtttaccactttgaaggtggaatcaaagaatacgttgcctttttaaacaaaggtcaagaagtgttatttgatgaaccaatctatgttgaaggtaattatgaaggtattgatgttgaagttgcattgcaatacaccaatggctataaaaccactttaatgacctttgcaaacaatattcacacctatgaaggtgggatgcacgaagctggttttaagactgctctaactcgtgtagttaacgattatgctcataaggctaaaatcttaaaagataaagatgacaacttatctggtgaggatattcgtgaaggaattacggcaattgtatcggttaagcaccctaatcctcagtttgaaggtcagactaagactaagcttggaaactcagatgctagaactgcagtggaccgagcattttcagaaacgtttagtcgtttcttaatggaaaatccttctgttggtcgtaagattgttgaaaaaggacaacttgctgaaagagctagaactgctgctaagcgtgcacgtgaagttacccgtaagaaatcaggacttgaaattgctaacttgccagggaaattagctgacaataccagtaatgacccaagtatttcagagttatttatcgttgagggtaactctgccggtggatctgcaaagcaaggacgttctcgtttaacccaggcaattttgccaattagaggtaagatcttgaacgttgaaaaggcatcaatggatagaattcttgctaaccaagaaattagatccctctttaccgctttaggtacaggatttggtgctgattttgacgtttcaaaggcaagataccataaattgatcatcatgacagatgccgatgtcgatggtgctcacattagaactctgcttttgactctcttttacaactacatgcgtccaatgatcgaaaaagggtatgtttatatcgctcgtccacctctatatcaagttcgccaaggtaaggtagagaaatatctcgataccgacgaagaattgcatgattacttaggtaccttgcaaccaagtcctaaaccaattgttcaacgttataagggactaggagaaatggatccagaacaactatgggaaactacaatgaatccagaaaatcgtcggttagatcgagtaagtcctgaatatgcggaagatgctgacaagatatttgacctcttgatgggtaatgaagtaggtccaagacgagaatttattgaaaagaacgctaaatacgttgagaatttagatgcttaggaggctttagatggctaacgaaaatcaacctcaagatcacagaatacgtaatgttgatttaacccataccatgcgtacatccttcttagactacgctatgtcagttattgtggctcgtgccttaccagatgttcgagatggtttaaagcctgtacaacgtcgtattctttacggaatgcatgaattaggagttacaccagataagcaatataagaagagtgccagaattgttggggaagttatgggtaagtttcacccgcatggtgactcttcaatctatctagctatggcccacatggctcaagacttttcatatcgttacatgctagttgatggacacggaaattttggttctgtcgatggggatgaaccagccgcaatgcgttatactgaggcaaaaatgagcaagattgcggttgaaatgcttcgtgatatcaataaagaaactattgattggcaacgtaactacgatgatacagaaaatgaaccagtagtattaccagcaagaattcctaacttacttgtcaatggtgccagtggtattgcagttggtatgacaacaaatattccaccacataatttggcagaggtaattcgcggcattcacatgttgatggataaccccgatgttactaccaaggatttaatgaaagttattcctggtccagattttccaactggtggaattgtgatgggacgcggaggtatttaccgtgcctatgaaaccggaaaaggaaatatcgttgttcgggcaaagaccgagattgaaactgaaaaaaatggtcgcgagcgaattgtagttacggaacttccttacttagtaaataaggctgaattagttaaaaagatagctgatttagcccgtgaaaagacaattgatggtattactggtgtacgggatgaatcagaccagactggtatgagaattaccattgatattcgccgtgatgcaagtgctagtgtggttttgaataatttatttaaagaaacccaaatgcaagcaaacttcggaatgaatatggtggccattgttaatggtgcaccgcatttcctaactttgaagcaaatgcttgagtactaccttcaccaccaagaagatgttattactcgtagaactaagtttgagttaaagaaggctgaagctagagcacatattttagctggattaagaattgcccttgatcatatcgatgagatcattaagattattcgcggttcacaaaatagcgatattgctaaggcacaattaattcaaaactttggcttagacgatcgtcaatctcaagctattttagatatgagattggttcgtttaacaggcttagagcgcgataaaattgaagctgaatatcaagatttgcaagcaaaaatagcagattacaaagatatcttagctaaaccagaacgaattgatgagattatttacaacgagttacttgatattcaaaagcgttttggtgatgatcgtcgtactaagattgccgaaggtgaagcagtttcaattgaagatgaagatttaattgaacaaaaagatgttcttttaactctaactcataatggctacattaagcgtatgccagcggatgaattcaaggttcaaaaccgcggtggacgtggaataaagggaatgggagtgcaagatgatgatttcattaaccatttaatcttctcaagtacccatgactttttactattcttcaccaacttaggtaaggtttactcaaagaaagcctatgaaattccagaatttggaagaaatgctaaaggcttgccaatagttaacctcttggaacttgataaaggtgaaaaaattcaagctgtaattaatgtacccgaaggagcggacgataattatctcttctttgttactaagatgggaacagttaaaagaacaaaagtcagcgaattccagaatattcgtcgaagtgggttaattgccttaactttacgagatggggatgaactgaataatgttttaactaccgatggaaaacaaaatattcttatcggtacccatttaggttatgcagttacctttaatgaaaaagatgttcgttcgatgggaagaacagcagctggtgtccgcggaatcaatttaagagataacgattatgtcgttggatctgatattctagaacctgattcagaagtattagtaatttctgaaaaaggatatggaaaacgtactgcagcttctgaatacccagttaagggacgcggcggtaaaggaattaagactgcaaacattactgaaaagaacggtcctttagccggtgtaacagtagttaatggcgatgaagatattatgctaattaccagtgcgggagtcatgattcgatttgatgtggacgatgtttctcaaactggaagagctacattgggtgtacgtttaatcaaggttgacgatggtgcacaagtagcaagtattactgccgttcctaaagctagtgatgaagacgaagaaagcactgctgaagaagaaccagtaaaagaaaattaataaataaaaaattaccaaattttttgcgtaataataattgagtaatgaaactcaggatcacgtgaaaaaatatttggtaattttttgtttatgtgataaaatcaagcattgtgagtaatattattcattactccttgttcttgattttaacaagaaccatttagtccaagaggaggtgcaattattatggcaaaaactaagtacgaagttacttacatcatcaagcctgatattgacgaagattcaaagaaagcattgatcgatcgtttcgataaagttgttactgacaacggtgctgaagaacttgaatctaaagattggggtaagagacgtttcgcatacgaaattgaaaaataccgtgaaggtacttatcacattatgactttcgttgcagaaaactctgaaccagttgatgaatttggtcgtctttctcgtattgataaccaaattttacgttcaatgactgtaaaattagacaagtaatttgttttcgtgaattaggaaggggacaaaagtatgattaataatgttgtacttgttggccgtttaacacgtgatcctgatttacgtacaaccgggagcggaatctcagttgctacgtttactctagctgttgaccgtcaatataccaatagtcaaggtgagcgtggtgctgatttcatcagctgtgtaatttggcgtaaagcagcagaaaattttgctaactttacttcaaagggttcattagttggtattcaaggtcggattcaaactagaacgtacgatgataaagatggtaagagagtatacgtgactgaagtcattgttgataatttctctttactagaatcacgtcgtgatcgtgaaaatcgtcagactaatggtggtaattttgctccgcaaggaggaaatgctccaagtaccaataattttggtggatcaagtgcaccaagcatgaataatgctcctgctagtggagaaagcaataaaccgcaagatccatttgcagattcaggtagcacaattgacatctcagatgatgatctcccattttaattttaattagaaaggatctttgatatggctcaacaaagaagaggtggccgtcgtcgtcgcaaggttgactttattgcagctaaccacattgactacatcgactacaaagatgttgatttgttgaaacgttttatctctgaaagaggtaagatcttaccacgtcgtgtcactggcactagcgcaaagaatcaacgtaagttgactgttgctattaagagagctcgtgttatgggcttattgccattcgtcgcagaagactaataacagatcacaattaataaaaagagtagcttatgctactctttttattttgttttttgcggtattataaaagaagtaaatggagggattgtcatgattattaagcaaaaactagccggaaacattgattttgactacaaatggtacgatatttataactgtgacgatcatgatattagattattaaaagatgattttgatttgacatccgaaattatctcttatattaccgaccttcacgaacgtccccactttgatcatgattatattactaacagtgatttgttggtttacgatgttccagtctggccaacagctgatgcagatcattttacaactttaccaattaagtttttaatggtcgatcatacgctttttactgttcattctcctgatacaacttatatgattgaagaatttaggcaacgaccagatgagcatattcatagtgaaaaggaattgatttttgctattctttttgctgttacaaaatactttcaaagggcacttagtcaactaaacagtcaacgactagttttagataataacttaagtgagcgaattcataataaagacttacaagaattatcacaagttgaaaaaagtttggtttacttatctagctcaattagaactaatctaatgatgcttgaaagtctaaaaaataaaaaatcaggacttcatatgaatgcttctgaagaggaaatgtgtgacgatattatcatcgaagttcagcaatcttcacaaatgatcaaaatttatagtgaagtgactgaagaaatttctaagacatctaataacattctgaataataacttgaacaataccatgcagtttttgactgtgtggtcactgttattaacaattccaacaattgtaacagggttctttgggatgaatgttgatttgcctatttttcataatccatttgattgggtaataattactgttggctcaattattgtaatggcaattttgctttggtatttacgtcgacataatatgctataatgcttgcttagcttagatgataagcaagcattttttgatgtataatataaagcgatgcagtatatatttttgatgatattaatgctataaacaggaaggaatttcaatgaaaggctttttacgcaaattagaattgcctgaatttgttaaagatacacgtttaacagcatcgttgattattgtccttgttttatccttattaggagcaattattgggacattaattagtccactttttggacttgctatggtgctgctgttcatcttaacaattatttttgtaatatatggaatttatgttctagctgggaatactaataattatgctgctaatctttcataccgcataaagcgtggggaacaagaggctatgattaaaatgcctctcggaattatgctttatgataaagatcgacaaattcaatggattaatccttatctgcaaatgtatttgcatggtaaagatattattggctcttctatctcgtcagtagataaggagttagctaaatatgttgatgatgctattaagtcaaatagcaatcaaaataaaattattaaatggggcgaccgcaagtttgaaatggttgtccaagatgacttgggtgtcgtttatttacttgatattacgcgctatgccaatattgaggagaagtataagcaagagagattagcaattggcttaatatttattgataattatgatgaattaagccaatctatgagtgatcagaacttaacaaatatgagctcatatgtccaaaatgcccttagcaattacgctggacaatttaattcatatcttaaacgcattgatgaagatcactttattttattgacgcatatgcatgatttagccaagatggaagaagataaattctctattttggataaagttagaactgaatcaagtcgaaagaatatgccattgaccttgtctattgggattgcgtttggctcagaaagcttaaatgaaattgctgatcaagctcaatccaacttagatttagctttaggacgtggtggagaccaagttgttgtaaagcaatcgggtcacgaagcacatttttatggtggaaaatctaatccaatggagaaacgaactagggtaagagctcggatggtttctcaggccttggtagaattatttaagggcgttgaccatatttttgttcaaggacatcgaaatcctgacttagatgcgattggctctgcaattggaattgtaaaaattgctcgaattcatggtgtaaaagctagtgttgttttagatgttgatcacgttaattatgacgtgggacgtttgattgctaaaatgcaagctgccggtatcgataaagatgtatttatttcgcctaaagatgctttagaagaagcaaccgatgagtccttactagttttaacagatcactctaagtacagtattacttatgatccagaactttacgaccggttgaagaatcgattaattattattgatcaccaccgccgcggtgaagaattccctgaaaatccaatgctggtatacattgagccttatgcatcttcgacttgtgagcttgtaactgagatgattgagtaccaacctcaagggggagaaggtgtcttgactgatttagaagcatcagctatgctagctggtattacggtcgactcaaaggaattctccttgagaactggaactagaacttttgatgcagcaagttatttacgatcaattggagcagatacgcaagttgtatctgaacttttgaaagaaaatatcgataattacttgcaaagaagtcacttagtttctacgattgacatgatcgaaccagatatggctctcttagtgggtgaagaaaataagatttatgatcccattattactgctcaagcagctgacacagccttgtctcttgaacacgtagatgctagttttgcattgactagacgaagtaaagatgcagttggtatctcagctcgttcaatgggtaatgttaacgttcaagtaattatggaaaaactaggcggaggcggtcacttatctaatgccgcaactcagctcaaggggataacaatcgaagaagctaaagttaagctcttgggagcaattaatgactatcttaaagaaaatgaataggagtgaaacttatgaaagttatttttattaaagacatgaagggtaaaggtaaacgtggagaagttaagaacgtacctgatggctatgctcaaaatttcttgattaaaaatggatatgctaaagaagctactagttctaacttaaataccttgaaacgtgttcaaaaagctgaaaaagatgcttatgaagcagaaaaggctgctgctgaagatattaagaaaaaacttgaagacgacaaaactattgttaactttaagtctaaggctggtactgattctcgcttatttggttctatttcaagtaagaagattgttgaaggacttgaaaagcaatacggaatcaaggttgataagcgtaaattagagcttccagaaccaattaaatcattagggtatacaaatgtacctgttaaattatttaaaggcgtagaagcagtaattcgcgttcacattacggagcaagactaataatggataatgttgtttctcaacaaattccccatgatagtgaagcagaaaaggcggtcctaggggccgtctttttagatcccgaagcaattattgatgcttcagatgtattacagcctgatgatttttatgaacatgcaaatagaattgtttttcaggcaatgcttaatatctcagatcgtgaggaagtaattgacccagttactttacaagatgagttaaagaaaaataatcaagtagatgatattggaggtattgcctatgttacagaactatcaatggcaactccaacagcagcccatgttacttactacgcaaaaattgtaaagcgaaaagctattcttagaaatctaatttctactagtcaaaggattattcaaaatgcaattgaaggttctgatgatgtaactgatatcttagatgatgcagaaagccaaataatgggggtctcccaggataatgcaagtggtgggttcaaatctattcatgatgtattaaacacggctatggaagaaattaactcgattcctgatgatggaaatatggtaacgggtctaccatctggattttctgaattagataagatgacaactggttttcacgatgatgaattaattatcttggctgctcgtcctggtgttggtaaaactgcctttgctcttaatgtggcacaatttgttggactaaaaactgataaaactgttgctatgttctcacttgaaatgggagctgagcaattagttcaaagaatgctagcttctgagggactaattgattcacagcatcttagaaccggtcagctgactgatgaagagtggcgtaagctagttgtagcagctggttcactagataataccagtatctacattgatgatacaccaggaattaaaatgagtgagattcgagctaaagcccgtagattagctaaagaaaaaggaaatttaggcttaattgtaattgactacttgcagctaattgaaggaccacgaagtgaatctcgtcaacaagaagtttctgcaatttcacgacaattaaagaaattagcaaaagaattgcatattcctgttattgctctatcacaactttcgcgttcggttgaacaacgtcaagataagcgcccagtattatctgatattcgtgaatctggatctattgaacaggacgccgatattgttgccttcctttatcgtgatgattattatcgtgaggagcgcgataaagatgatgaaggcgaagtagaagcagaagaagataacggcgaagtagaagtaattattgagaaaaaccgttctggtacacgtggaacagtaaaattaatgttttctaaaccatataaccgtttttcaaatcttgactatactcatagcgaggcttaaaaaaaagatttgtaagcgtttcattaattagctatactataatagttaaaagtatatctttttagtaaagttaagtgaatgagaaggtgtaagttgaatggtagaaaataaatatgtcggcagtattgaagctggtggaactaaattcatcttggcagttcaagatacagaaagtggcaaaattgtagctaagaagagaattccaacaacagatgcaaaagaaactttagcaaaaagtattgaattctttaaagagcacccagtagctgctttgggaattggtacttttggtccaattgacatcaatccaaattctagaacatttggttatatcttagatacacctaagcgtggttggtcaggaaccaatgttaaaggcacttttgaaaaagaactaggtattccagtggtaatgactacagacgtgaatgcttcatgttatggtgagtatattgcacgtggaaaagatgattctaagacttatttctatgtaacaattggaacagggattggtgccggcgcggtacaagcaggtaaatttattggtttaaataatcacccagaaatgggccacatgctagtcactccttaccctggcgacaactatactgggaaatgtccatttcatggaaataaatgtgttgaaggaatggcagctggaccttctctagaaggaagaactggtattccaggtgaaaaattacctagagaccacaaggtatttacttatgtttcatactatgtagctcaattattatttaatgcttacatgacaatgcgtccggatgtaatggttgttggtggatcagtactcaatgatcaagacttggtccaagttcgtggattctttagagaatttaataataattatgtcgcaacgccagacgtcgacgaattaattgtacgtccagcagttgaagacaatggttctgcaactttaggtgactttgaactagctaaggaagctttgaaaaatcaataaaaatatatagtaaaaaggcaacttcatttgaagttgcctttttgtgtttcacatgaaacaaatttaacttccatcatatgaatcatcaacaattggtcctttacttgaatcgttgccaaggggcgctagatgttcagtatggttaagaaatggaagattaatgtattgacgtgctgtcgtggtaatatcagatactatttcattagcaattaagcgagttttgggatctaatgaaagataagcatgactgaattggattgcgccacgaattttattagttgttagttgactagcatcggtaattttttgagattctagagcagtaaagaaagcaagccagagctcttcacgtttttcacgtggaatttttgtattccaggaaataaatgtacttctaataattctgctagcattgctgagacaaggagccataacgaagctatttcgagcaacttcccaatgaaggggattatgctgctgcattaaatgtttcatcttgcttttaactacgatgacacgttcgggatgatcaagcatcatcccaaaaattgatccttcgggaacataggtaatcatcttgggaatagctctttgaaattctagttgatcataagtttctttcataaacccaggaccatcaaaactatatgcttttattatttgatcttgaattttaggtgaaacagcagagatagcataagcagcaaaatttccaccttttgaatgaccagtagtataaatttgcttatcaggataagtctgggcaattttatctaaatagtctgctgctacactttgtccaaaaatttctggctgataactcatatctacatcttcattcagtccgaccatggatccatcagttcctcgataggctactagaatagtctgaggatctaattcaattgtcatggctgtgaactgtactggtggctttttctgggaaagatgagaccagtctaaaaagcgcatatttttatatcgatcactaaggttgattaattgagcttctactttatctgaatgaattaatgtctttttttgtattaaacgttttgtagctgcttcgagagtatgccctttaacactagaatcaaaaggaagataagcaaatgcggcaaaaagtccagcatctaaactattaaatggttctcgatcaagtgttaggtcccctcgccagcgaacataatcaagtattttacccaagataaaagtcctctcattaagggttgtattatttttattttaatgctttttggcttaaagataaaagcagaacacatttatctataaaaaaagaagagctaatgctcttcttgattactaaaatatcagttgaatagtttcaagaggtgaaagggaagacttaattgtagcaagattatctcttacatcaattttaactacttccttttcaatgctactaccatactttctaattaaggtagccgtagtagatggtaaaggctcactgatgtgccatttaatctctgtataactatctaagttgaaattagctagccagactactttgccattttcttgaatatttaatttaacgtgaggcatattgattaagtagtcagtaggttcaacgctagccataatttgttgcatcaacccttgtttatatgaagaaaattgtgattcccaaccgtgttttggatcttgatccatgggaaggacaattatatggtcatcaataactgccatgaaatttccaagtttttgatcgatagaattataagccgaactccaaattttgacattgctatttggctgataatcaagctgtaaataattaccagtgtgttgaagcatggtaatacgtggatttttaacgccttgaacagtaacaccatctgcttgttcaaatgattgatatccacttttagctgcatgccatttagccgattgaatatggagtaagttacctaaatctcgatcaagcaaaacttgaatactttcaccatcaagtagaactgtattttgtgtgattagtttagtgatttgactatctgtaagattgcgcagcagttgaccagcgattgcaattgtttgatcttcgatttcaaaattatcttgaataggcaaaatagttgttgcaaagctaaaactggctaaaagactagcccagtttttttcatggggaagcaattcttctggctctttgccccaagtagtatgagcagtataagcagaatcctgatctactagaactttaatacctcttaattctttcatattgagacggtggttagataaggcagaagcaaatggtttaatatctgcaagcattttgccatagccccaatcttcattaattccgttgcccatcatatcaaagatattaagcataatgccctttgcaccaagaagggcagtcgtaataatttgaaaagcaataaaggtattagattttacttgcggagtccacattgaattttctagttctggatataattcagcatgtgggcctaaaaacgcagcagtattacggctatattcttcgaatttgcgtccataaatcaaaggagctacttcgttataagctggtaggtgaggccgggctacacgtgggtgtccaggaccagcttgagcatcaaatagcttagcccagtctctgccttcaatagcgtgccagtccggaaatgaagtcatttgtcccatatcagtatctggacttaccttatggactgcttgttcaatcaaatgctcgttttcaatcatctctttgcgagcttgatcaagataaatctttcgttcaatagtaggctctccaggctttaacatgtttttgacaaattcttctcgactttcagccctacctagtttttcttggtatagcttcatatgatagtcgcagaagcacatcaattttagaggagtatggttatagtgtctaaagtcatcctccatccataaacgacgaggatgaattgaggcatattgtgcatattgctgagctaaatatttacgccaagtaggatctgcaggacaagccatatctttagccttgttaccattaatatctacaaaagtattaaagccaatcttaggattaacactaaatccacggtctgagtgcataatagttgtccatggatttaaactagtcgtaacaccaagtttagctagttgcttttgtagggggataatggcatccaaccaaacttgagtctcttcttttgttaagtggctatggtttaattcttcaccgttaataatgaaagctacgtcatcaatttttgctttttgtacaaaatttaaaagtttttcatctttttcaggtgtgttggtacgtggatcaaaaacgtaacgtaatgtataagtgtagctcatgttatatcctcaatattcatactcaattaatattagtaatgtttgtcaatgtaacttattatattaagctacattgacatagtaacattatttgaaagcgttttccagaataacaaaataaaatattactaacttaactaaaaaatcaaaaaaactcttgtgtattaataaaatatatgattaaatacataattgtcatctaaataagctgacttagctcagttggcagagcacgtcactagtaatgatgaggtcgaaggttcgaatcctttagtcagcactataagaacaaaaaagcgctagtttatctagcgtctttttttatttttatgctaatcatgattttcatttatttctatcgccttatttctacttgttttttccttacgcttaagatagtaaaaaataggtaggccaacagctactattcctaaaaatagaactacaccagcaggatcattaaatagttcactgacaatgataaataatccacctaaaattgcaacgattggtactaaaggatagagcggagtactaaaaggacgattagaattttctcgtcttaatttaaaaatgccgaaaaaggccaaaatataaaagcaatatatcgtaaagacacataagtctgataagcgatcaggatcgaacaatactagcattaaagttgctaatacggtgataaaaatagtagcaacgataggagattttccttttggagttaaataggttaaataagatgaaaatggcaaatcatttcttttagccatagcataaacaattcttggaaaagtaataattttaccattgagagtaccaagcatcgaaataattattcctaatgttaatagctttccaccaatattgccaaaagcttttgtagctaaatacgtagttgtatcctctcctaggcgctcaataaggtcggctggaataaagcgtaagataccgactgtaattagagtgtagatcgttaaaacaatcgtaattcctaagataatcgcttgcggaaggactttttgaggatttttcatttcaccacctaagttcgcaattaaaatccagccgtcgtaagcaaacaaggtagctaacacagcaactccaaatccgccactactttgtttaacgtcagaaatagtctgacctaaggcattattttgaccccaaaagataccaaaaataataattgcagcaatcggaatcatttttccaattgtagtaataactgaaaatgctgcacctaccttattatctaaaaaattaataatagtgataaaaagcatacacccaattgatagaggaatgcgccaggaatcatttagattaaagaaattggcgataagaataccggtaaaaccacctacggctgcaataattgcagggccatagacgataacttgcatccatccggctagaaaaccaagaatccgaccatataacttctcaatgtaaacatataatccgccagtatatggcatttgagctccaatttcagcaattgttaaaccagctgctagtgtaataacaccaccaaagatccaagcactaatagctaaggttgaattatgagcactttgaagaactgaagcttgtttgaaaaagatacctgatccaatgattgtcccaataacaattgaaatagctgaaaagaagcctaatgaacgcttaagatggttttgttgtttcatcttgataatcctttctaaaagaaaaaagcccagattcacaaaaatcactctgctataaaagtgattaagtgaatctaggcttttttggaaatatttggccacacaaaatcactcatgttccactggaggtggaagatgaggaggaagaagcatttaaattagtgcagtgtaaatatttcatggttttaactcctaaatgattttatattagaatatcatgatattattaaaaagcaaataataaatacatctttaattaagtaattaattttattgtaaaaaagttttgctttttccaaaatcatctgctatactaattaacgttgtgagaaacgctgacttagctcagttggcagagcacgtcactagtaatgatgaggtcgaaggttcgaatcctttagtcagcacaatttaaaagtcctaaccagatggttaggacttttttgttgcgcttttatcttagtataatgaaaatatagacgtatattatctgataaattgatatttcaaaaaaatcttagaaaaggtaaaagcagatgaagctaaataaagatagtcaaactttagatcaaattgccccattagttgaatattcctttttaaaaactaatgaccttcatcaagatgttaattttttaagtagatatgaccatagtatgggggttggcgaatataaagatggaaaattagctagttacatcatggtcaatgaatttgaaagtagaatctttgctaaaaaggtaaaaatgggtggagttggttatgtagcttcatatccagaaaatcgcggtcaaggtgatattaatcgcttgatgaatgaaattattttagagttgtacaggcagaattatgctatttctaatttggcaccattttctgaaagtttttatcgacgttatggctatgaaaatgctatttatgaaaaaatgtataaattaaatccggcttatttgcgcttttttaagtcagttaaagaaggaaaaattgtccgaggaaaatggaaagattcagacttaaaagaagcagtcataaagttatatcaagataagctgaatcaaaataatcaaagaaatactgttgatcgtgaagactggtggtgggatcgtttagatacctattatcctgggagatttatctgtgtctactttgataaaaataatcagccagctggctatatgttctatcgtattcgggatagggagtttagggtgaaggagctgtactataaaacgcctcaagcagcgaaagccttattgagcattattgctagtcattcttcaagtgatttgaaatattatgtgaaaatgccagaatcaagcttactaggcgaatttttcccagagcaggaaggattaaaagttcaaattttaccttacatgatgactcgaataattaatgttgaacaagtattagaagccttgcacttaattaataccggtaaaattaaaatcgaaataactgatgatgaaatagttgctgaaaataatgggacttgggagattgatcagataaacaaagagactaaagtgagaaaaactgaaaaagatccccattatagcggctctttaactaattggacaaaagttttattaggtcatttaactttgaaacaagctgttcgattaggatttattaaggaacatcatctagtagataatgattttataaagggtgaagtttcgttttatgattacttttaattaaagatagattttctgttattagaagcagaaaatctattttttcttatagccggcaatgtcccaatctgtaaaagtataatctaacttcttcccataatatttttcatatgctgctttcttttggaggtagtcaactttacgcattttttctatattttgagcaagtgagagtttgggatcaggataaatagtaggtagaacatgaagaatccaacgtgttttgttaaattcaggatgcagtttttcttgcttgttagtgtccttaatttctacaaagcatgaaataattggaacattcattttagctgcataataataggcgcctttttgcagaggacgaggttttcgataattaagccataattcttgttctggatataccacaatccagcgatttttcttagaaaggattttatttaagtgttttggcagctcacgtcctaaatagcgaaaactagcagttaccgggatgctatcaatattcctcattaaaaagccaatccagtttggtagttttaaattagtatcttcgataacaaaatataatcgcttatgatatttcatggcgagccgcttcagagggagacaatcaaattgattgtagtgattacaggttacaatagctgaagaaagcttactaagagattcaggattatcaatttcagtatttaaagttaaaagaggcgttccgatgttaaggattccgcgtgcaagtatattaatagctttagaaaaggggctattatgattagcccaaaatttttctactaattttaggcgatcttttttgcttaaaactggatcatctggttcaacttttgcgttaaattttttctccttaacacatcttttaatattaaaaataacctcttgtcgctttttaccaataatcataactagctctccaaactttttaggatagattccaagctctattttatttattttgttttttaaaaccaaatattatcccacttatcttcattcatgctaagctaaggtgaaagaataaaatataaaaggaggaatccctaaatgaaagtaggtattattggtgcttctggaatggcagggagtgctatttataaattagctagtgaaaacaaagatcttgaagttacaggtattgtcagagataaagaaaaggccgaaagagttcttggtaaagatgctcaccttttaattggcgatgttttaacaatggacgatagcttactagaaaactttgatgtaattgttgatgcctttggtacaactcctgaaaaggcaaaggatcaagtaaagctagcaactaaattatgtggtctagctaagaacaaggatattagagtaatctttatcttaggtgcaggtagtcttagaactggaattgataaccacttggtagtggaagacattaagaaattaactggttcagaaaactggattaatacccctcaagagcaattaaacgaattaaactacttaaaacaagttgaagatgtagattggctgggaatttcaccagcattgacttttgaagcaggcccagaggctgcaggttatatgttaggtaacaatactcttctctttaataacaataatgaatctaaggtaacctctggaacaatggctcgcttgattgtaaatgaaattgctcatccaaagcaccataaagaaagaattactttagttgatgaataaaaaataaccgctacaacgctcagacgctatagcggttatttttatgtaatgtttaatttatacatgattaaaatgtaggttttacgacaataaccataaattctttcaccctttaaagatttaattttcatctctattatttattaatatcttgaagatgtaataaaatttgcatatctaatattaacttgcatatttaaatgttaggcaacaattctatataatttgaaaatcctgaaagcataagagtggtcttgatatgatctatagtagttttatctttttctaaaatggcttgataatatttgccaagcaatttatacatcaacagttctggagtactaggcaaactaaacaaaaaagatattccctttttccaaaaggtaaagttttttcttttataacataaatctaaaaaatttatacaaatacttgcaatgaacttttgaactgtttcatttttagttgtttgatatttatttaaaatagaagttagtagaaaagataactcatcagaagtataaataaacatagaattagtaaataattttaatgttggaattgaccaatttaaaccgttaaatagttcttttctgatgagatcttcatcctgtttatttaatatagtcctatcttgttttaaaagagcttcaattaattttatatataattttgtagtttgtgatgcccgtaagtatatatatttttttaattgcatgacagtgtctatatcgttattaaaaaatgcaataaatagtgtatctattatttcatcttcatcagtttgattatttagtttaatggttagttgatcaatgaaatcagatatattgatgtgatggacttttaaaattttaagtaaatcaatggctgaaatacgagtattatcctgttcgactcgagagtagaaagacgttgaaactattgttccggccatttctttttgtgtaagatttagtttcttgcgattttcttttagtaattctccaattgtcattattgtctatcctttttcagaaatgcatatatgcaattataatatagtttatgcaaatatcgatatatatttttgttttttctttatgatgtaatagaaattaaaagaaaggacataaaaaattatgcatagaattatgaaaaattaataatcaatttaagaagttaaaatgcttttaaattgaataggctaaaaaggctgataaatcaacgctttgacgaagattatcagctttttatttttatagagtttatgatgagtaaggtggtaaattatgttttacaagactagttatttagcaacaggtggctgtagtaatcatcaagggattttaggtgtaggaacgaaacaatactttgtaagtgaagccgactatcttaagtctttaaaaattttagattttttattaaataaaaaaacatatgatgaagttataaaattttgtgaaaaaaataatattaataaatctatatttgacacattagttgagcataatttaattgttaaagaaaatctttatgttgagaaaaaggatgatttaaattttaaaaataaactatattttcatgcattaggcttaaatggaaatgcacttgcaaaagaatttgcagatactacctttgtaattgtagggtgtgggggaattggaaattttatttcatttgctataggttcactatcaccgagaaaaatagaattaattgatggtgataaaattgaaaaaagtaatcttaatagacaatttttatttacagaaaatgatattggtaaatataaagtagatgttcttaaaaagaacttggttgagagaaataataaattaagtattagtgaatataaagagtatgtttctaaagaagtattacataatatttttgaacaaaataagaaaaataaaactttagttattctatctggtgacagtttttctgcattatctttaactgcaaaagcatgtgtaaaaagtgaaataccttttcttaatataggatatttaaatgatatttcagctatagggcctttttatatacctggtatttctagttgtccgttttgtcacaatgcgttatctatttctgatgacatatctagtggacataatgaaagcaaaattttagaagatagaatcaatgctaataacgaggcaccatcaagttttacaaataatgcacttgctgccagcatgggaatggctgatattattgagttcttatctcataattacgaacgtattaattctttaaataagagatttgggattaatagtgctacatttgaaaaatacgtattagaagtaaatagagatagaaaatgcgagatatgtagtcatggagaataaaaattatgagtcttttaagaacaagaaagaatataatagaatatttactttcatacgcactaacaactgtagcaacggctttgcctcatgcagttttgaccatcatattatttcaaaagggcctttctttagcccaaataatgatggttcaaactgcatatagtatagcagtatttatttttgaatatcctagtggattatgggctgatctttattcaaaaaaatttttatttgttttatcaagaatattactaataataatgatggtaattgttctgcttatgcggaatacaatctggatggaaatagcttggttcatctatggaatttcgagtgctttagacagtggtaccttagatgcagatataataaattctctaaaaaaagataataaaaaatcaaaattaggtagatttattagtattagtaatcaattagactttatatctttacttcttggaagtactattggctcgtggttatattatgcattaggaataaaattttattatataggaattggattggtaatattagctataatttcaatcctagattataaacaaaatgttggtgcttcaaaggaagataatataaccttggtcaaggaaataaagagtggtttaaaagaggttaagaattcgaaattaatgcaattaatgatggctcttacattttcaggccaattcttttttcaagcacattatcaattatggcaaggattgtttttgtataaaggtttcaataaacacaatttttatttattatatattattttccaattaataagtttaggcacttatagtataaatttaaatatcaaaaaaaataaaataaaaattattggttttagcaccatagtagtattatctttgtcaatgattctttttttgattactaaatcttattatttcgtttttagttatatgtttttaatctttatatttacactagttgaatattattgtaatgttatgttctcaactatagtatctgtagaaagaatttcatctttaacatcattacggtcaagtattggtagaattggagcaatttgttccatggtagtatcaagtatactgttaactaaactaaatgtacttgatgttgttgctattaattttggaatagcaatttttacaactttggctataggtatagtattgtatagtcgaaatagagaaacattattttcagaaaaagaggaataagtatattgaaatgattgaaaagtagaactaggacgtatgggtactaatcaaatcattttagttataaaaagtttaatcttgttaaatttagtttgtaaatgaaaaacagtaatagaaaagagtctgactagattaaactgttttaagtttaacgttacgttataactttctgtacataaaaaatgatcctaattttaattatttatgttgtctacttaggtaggatcatatcaggttaacaaaccttgatttaataggatgtttgtgtagaactaaagcccaaaatttattaaaaataataggaatgtctctcttgaaactaaggaaacaattgaataaaaaataaccgctacaacgctcaggcgctatagcggttatttttatgtgatatttaattattagcaactaatgaacgataaaagttagctttggtttgacggtagtaaggcacaatccagatgaatccaataccaaaagtaataatacccaataaaccccagccaatgaagcttaagtctaagacgaataagtccatcttgtgtccgtccattaaatgacgactttcagtaattgcttcagttgctcctatatcagtttgtccggcagcaaatttatcctttaagatatatggcgtcatggcataagaatatcccttaatgaaggcaggaataataaatgcgaataaccataaagtaataaaaagattggtcataaaaagagtaaacaaactattcttgaaacgtccattgctgtaggcactgaaaataccaacataccaaggctctttctttcctgtttcaacgaaatctaggatagtataagcaactccccataaaactaaaccagtaattaagccgacaataaatgtcgaaagatcataaccaggcttataaccttgaattaatgtttcattgttatagcgaagaattgagtaggtaaaatcttttccggtccagatccaacgattaatatccatgatgacggcgttaaataaccaggcaaaaatagttagacaaatagcccagccccaattgccacgtaattgatctttggatgcttgtttcatttgtgcacgtgtcatagattgctttcctccataatatgctaaatatatatccatcttatcttattactttgaatacagataggataaaattaaaatttctcaacttttgttataatcgaaatactaaattaaatcgaagaagggttgctcatgaaatataaacaattaatttttgacgttgatgatactttaattgactttgctgctacggaagattcatccctgcatgcattgtttaaatcacataagctgcctctctcatctgacttgcagaaacaataccatacgtacaatcaaggactttggcgcaagcttgaattgggtgaaattacttatgaagaattaagcgagatgacatttcatgactttattaaggaacatttcggtctagaagtagatggaaatgaatggatgaatgaatatcgctcttactttggtgaagctcatcaattgctaccaggtgtggaagatacgctgaaatttgccaaaaaacaaggctataagttaacagtcttaagtaatggtgaaaagttcatgcagcgccatcgcttagaattagcaggtatcaaagactactttgatttgattgtaacgtctgaagaagctcattattctaagccaaatccgcatgcttttgattatttctttagccgcacagagattgggccaaatgagactttattctttggggatggattgcagtcagatatcttaggtgctgaaaaatatggctttgacagtatttggtataatcaccgtcaccgtaaggataatattggacttcatcccttatttgaggttgaaacatatccagaatttgttaaattaatgcaaaacgattttaagaagacatattaaaaggagtgcttaagcactccttttgtgttactatttattctttttcaaaaccaaccattaagccgccttcttcagcatagaagctgcaaagtgcgccacattcgccgatagtaactttagcatctgggaagttatctaagataatttctttcatgcttaaagcagagccctcattttgcacatggtcaatttgaacgcggcctccgcgatagccagctttaaccatatcatctaatagttttcttctagccttcttagccccgcgtgccttacccaaaagttcaaattcgcctttattgttggcagttccgataacgaaaagctttaacaaaccagcaattttagcgacagctggagtaatccgtccattgttacctagattggttaaatcctgcaacgcaaacattaaatcaaggtgatgttgatattcttctgttgctttaacaatctcttcaaaagattttccagcacttgccaaactagcaatcttttctgcaagtagtcttaattgtggaccagctgaacgagaatcaaagactaaaattttagcttttggattcttttcatgataaattttagcagcttgggtagctgaattataactaccagagagtgcgctagttaaagtaatgacaaagatttcgtcgctaccttcaaaggccttaagccagtcatttacgtttggacaggcagaagttgatttgtttttagtatgctttaaggtgtagagaaatttatctaaatcaatatcaggcgtatctagccagagcttgctatcaacgtgaagtgataaaggaacagtaacatgatcaattccatcgatttgatcagctgtgatattcgcagttgaatctgtaataatttttatcggcatatagattacctcgaattaaatatattaagctgttttctttcagtctaaaataatatggatagtaaagtcaaagaaaatgctatcagtacaaaaaaggtcagcccgagagctgacccattgttaatgtgaaaatactagtcctaataagccgcctaaggcaactaaagccagaaggggcaatactagataagaaacgaaggcaaatagcagtccaatcacgattaagaaaccaacgatcttcaaaatgccaattcctagtttccagaacagccaaataattaataaggctaataaaagtgaaaacatatttcgaaccttcttataaaaatcaattatattttgatattaatcatattacgaattaaggagaaagtgtagataagtttttattaagaatatttaggataattttcgttaacgaaagttgcgttcaaatacgataaactaagaacattttaacctttttatctaaaaatgatgatagaggtgaagaaaatgaaatacttattgagatatttaaaaaaagaaccagtaaaggttggtatcgtaattatcctaacaattattacttcagctttacgagttactcatgctttaatcaatgtaaatattctaaattctttgatcaaattacagctgcataacttttttaactgggtaatgattgatattggagtatttgcaatcctatctatttttctgattttgcttcaaattcaaacagctaaaacaattgaatttttatgcttggatttaagaaaggatattgttcgccaaattactaataagccaattatgaaataccaggaaaaagatacgggagtctatgcttcctggttaactaatgatatgaatacaatcgaaaataatggtttttataatcttttacaatctattcaaattattaccgacccattattttcgattattgccttgctacaattttcttggacatttattcctttaattttactagtctcatttttaacagtttttttaccacaaattgttcatgatagattagctagtgcgagtttatcaactactcaagctaatgaaaatttacttagtactattaatgatggcttgaggggctttgcaacatattctatttttggcgttgagagacaacttgaaaatagaattactggtgccacgatggccttaattggtaagaaagtacgacaagcgaaatatcaagcagtagctaataatattgctggtttttcaaatattttaggacaaactggtattgaagcttggactggttttctagctctgcaaaaaagtatctcgattggtgtaatcggatcttcaggaaatttatcctacaatgtttttaattcattagctgcgattgcaccaatgtgggcagaaatgactgcattgacaccaatttttgaaaaatatcatcttgatgataaaagtaagcctaaacaaactggtagaacacttgaaaataatgattttcaatgtttagatattgagaatctacaaatttcttttggagataaaccagtttttaagcaaccattaaatttacatataagtaaaaatcaaaagattgctcttgatggcgattctggtagtggtaaaagtacacttttaaaaataatttcaggtcaaataaaaaattatcaggggtcagttaaaattaataatcaagatgaaaaaactctcagttatgatgccattagagaaacattgatttatgtggatcagattccatatttatttaacgggacaattcgttataacttagaattaggagagcactttagcgatcaagaaatattcgatgccttaagaaaagctgatttgcttgattatgttaaagagttaccagcaagattaaatacaaaagttggcgaaaatggtacaaaaatgtctggaggacagaagcaaagattagctttagctcgtggcttactaagaaatagaaagctatttttattagatgaaagtacaagcagtttagataagaaaagtgctttgaatgttgaaaatatctttttgagtcaaccagacattacagttatttttgttagtcaccagctacacgatgaaaacaaacagaaatttgataggatcgttaagatataaaagagacagatagatgaatgtactatactttcggtaacatacttacaaagtcactatatcctgcaagttttaaaattttagttatttgctgacaagtagccgtgtccttttgaaaaacagacgcataatattttccaagtaactttataaataggacggaccctttgctattaatggtcgaaatataagttaatacctcttggattaactttgtggagtttttctcgtagcaattatctaggtaattaatacagattgcgccaatgcattcttgcaaagaactttgcagagtatttggattagaatacttcgctaagatagtacctactaaaaaattcaactcttctatatcgtagatacgcattgtttctctaaaaatttgaagggaatgaatattccaattgttgttgacgagaatatattgtttcagtttattttttaattcaattggaatttctttagctttaggaagatagacctctaaagtaagctgcaactgcaatttataatattcagtttggcgattattaggaagtaaatctatctcttgttttatttttaataatttatctttgcttttttgctcaaaagctacagaaattctatccataatatcttctgagatattttctctttcatttagattttcaaaaaaataggtagcgtttatctgatgtttattaagaatttgaaggagatcgttagtcccaatatcgtgaatatttctttcaactttcgaataaaaagaggttgagactacatttgcagccatttctgtttgagttaatcctagttgtttcctaagatttagcagtgcttcaccaattgtcattctgtatacctcaaattcaattttttaataataattttatttaatgcttattctatcacgttataggatgataataatttcaattgcgttaataagctataataaagagaaattacaacaaaattattacgattacattgagaaaactagaataatgaaaaaactaacaacaggaattttagcccatgtggatgctggaaaaactaccttgtcagaagggatgctctacaaaagtggcacattgagaaaattaggtgcagttgataaaggaactgcctatttagacagtgatgatttagaaaagaaacgcgggattacgattttttcccatattgcccgtattcaaaccggtaatagtgaattacaaattttagatacgccgggccatattgatttcgctcaagaaatggaagagacgttaagtgttttagattatgccatcttagttgtatcagccagtgaaggggtaactggatacacccgcactctttggagcttactaaaaaagcatcaaattccagtttttatctttgttaataaaatggataccttgaaggctgataaggagaatattcttaagcaacttaatgagctggatgacaattttattgagtttggtaatcaagatgcagatttttatgaaaaagtagctactgcagatgaaacaaccttagatcaatatctagaacttggaaaaatagaagatagtgcagtcaaaaaattaatcaatcaaagaaaaatttttccagtatattttggtgcagctttaaaattaattggaatagacgaatttctagcgggcttagataagtggactgatggaaaaaagtatacaaatgactttggagctagaattttcaaggtttcttatgatgaaaaaggcgaacgcttaacttggttaaaagttaccggtggtagtttaaaagccaagaccgagatatttcctgacgaaaaggtgaatgaaattcgtcgctataacggcactaagtatcaagtcattccgcaggcagaagctagcgaaattattgctgtcagcggcttgaaaagtacttatcccggacaaggattaggctttgaaaatgatcagactaattttactgttcagccggttttaacttatgcagtaaaagttgactcagctaacacaaatgcttgtttgcaggcattaaaacagcttgaagatgagaaccctcaactacatgttaagtggaacaagcagacacaagagataagtattgatgttttgggaaagattcaattagagattctccagcaactattacgcgatcgctttaatttagaagttgaatttactcagggcaagatcctttaccaagaaagtattaaagcttcagttgaaggggttggtcactttgaacctttgagacactatgcagaagttcacttgttactcactcctggtaaaaacggaagcggcttagttttcaaaaataattgtagtttagaagttttgcctaaaaaatggcaagatcaagtgatggagagtttatctaataaagaacacttaggtgtcttaactgagtcgcccattacagatcttgaaattactctagttggaggccggggaagcaatgttcatacagttggcggagattttcgtgaggcaacttatcgtgcagtgcggcaaggattaatggagctaaaggctagaaaacaagtttatttacttgaaccttggtaccaattcactctaagaattaatcaggatcaagttggtcgggcgattaatgatattgagagaatgggtggaaaatttgaactcggagaaagtagtgggaacgtcactacgattagcggtcaagcaccggtagcgcagatgcaggattatgctactgaagttagaaactacacgcatggtactggacaactagaatgtttattcttgggttatcgagaatgtaaagatagtgctgctattattgaagaaatggcttatgatccactatctgacattaacaatactcctaactccgtcttctgctcccatggcgcaggtcatacagttctgtggaatgaggtaccaagtcatgcccagtatccatatttaggataaattgctgcacgattttggtagatcaagctaaataatttttgcagtaaaacgctttcattatttatgaaaaggtgccatattaaaagtgtgaaatagctctagtagaagtcacgattaggattgttaatatttatattttttattaagtcgacgatactctagctattgcaattcataaatatattttataagaaaaggaagttctgattaatgaacttccttttttggtgctaatagaaatgtagttaaagtaactacttgaatcccatttgcttgcgtaggaccgtgtagattggttctccacctaagagagctagaattagataggcaataaagacactcataatcattggcaaaacttgttctactgttccgatcatttctgtcaacaaaataattgcggtaaatggggcgcgcaaaattgctccgaggtaggctgccatagagacaacaatgatattagtatagttgtcagtaggaattaggcctaagtgaataaatatagtcgcaaaaatcgtccccattaaagcccctaaaactaaaatcggcataaaagtaccaccaggaatagaactacaataagaaatcatagaaaagattaatcttagtagaaagaagacaactggaattagaatccaggaaagttgccctagtttttcttcttggataattaaaggattgtgaaagagtgaatcgatcaagtaatgtgatccacccaaaacatgaggaaaggcaagtccaataggaataactaatagaagtggaacaatactgtgatattgtatgggaataatttttatcttgctaaaaagccatttagtatttaaaagagaacgttgatatccatatgccattagcccggctacaattccgatagtaattaatgaccagtaggagtgaacgggcaattttttagcaatgggaagataaagacagggacgcgttccaaaaaatataatagtaactaagtcagctgaagcagcagcccctaaagcgctgatgcattctttagggttaaaagaatgggtaataacttcaacaaggaaaaaaacacctgcaagtggagctgagacggcggcactaaggccggccgcaattcccgcgcattgaagcaaacgtctatcttcttcactacattcaaaaatattttctgcaaaaccttgacctactaaagcacccatttgaatacatggaccttcgcgaccaagaaaaagtcccattgagcttactaagagaccacctacgaattttcgccataaaacgggaaaccatttaacttcgtgttctcccattaatgttgcttctacttgaggaatacctgatcccgataggtctagtaaatatggtttaataattttgctcacaaggatacaaataaaaaaagtaaaaattgtatatagaccgatccattggggatgggatgccatgtagggatagagaaagtataaaaaatgcatgcttttatcgataacaaatcgaaaaatactgactatcattcctataattaatccaataatgatgctctgaattaaaatctgtggcactcgggtagtaaaggggcgtctaagaaaatctttagcaggcttcataattgtgacttctttcatgtatacgttgttaggtttattgtatgccgaaagaagaaaagaaaacaaataatagatggcaaaagagccctactagatcaatgattttgatctaataaggctcttttgcactgaatcacctgtattcctaaatgaccagtctaagtgtatgtgcagctcaaaaaagaggtacgttgatgtgataaagagtgagatctgaaactactcaatacgtaatttctatttaaatataatttttagctaaatcttccttgctttttgtcctaaccaaaaatttccagtaaaatttacttttcttaccaaatatgaaccctcttttcgggatcaagccacattccgttggctggctggatattaaaagtttgatagaaatcatcaatgcactgagcaggtacatttgatctgagttcacttggggcatgagaatcataggcaatgactgattttctaaattggggcatcatcttaccacgccaaattttagcccatgcttgaaatacctcttgtagattaccattttcttttttttgcggtttctacagcaacagttaatccacctaagtcggctacattctccccaacggttaacttgccattagtcttaagaccaccacaaataataccatcaaataattctatttcagcttgtgaaagttcagtaaatttgttgtaatcttcttcactccaccagttacgaatattaccaaattcgtcaaatttagacccgttgggatcaaaagcgtgggtaatttcatgagcaattactgcaccaataccacctagattttcactcaaggtattatctgaactataaaacggcttttgcagaattgcagcggggaaagtaatatcattttttgttggatcatagaaagcattgattaaatttgctggagcacctggtccccaaagagtccggtcaactggtttatataattcattaaaactatactgtacccatgtcttattagcagcagatatattttcagataatgatttatttgttgaaacttgaatgtcattatacacgtcactaattttatcgggatagccaatttttagggttatatgatcgagtttttttagtgcttcatttttagtagattcactaagccagctgttatcttgcaatctttgcttataagtttcaagcattttattaatcatttgctcaacattagcttttgcggttgagccaaaatatgattgggcgtaataaataccaatgacttccgcaaagactctgttagcaaccctgtaagcttgtttttctgtagaaggtaattctctaacaccctctacagcctgcttgtagggaaaagcagccttttgaaattcttccgaaagataatcagcggaactattgacaaattttactaatatccagcttttaagttcttcgaagttttcgggattaacaagttcattaatgtgctttaaataatctggttcgataacaataattttttcaggtactttagagaaaaggctatttaaaagctgctctatatctaaaaattcgaaagaagaagcaaattgttgagttgaataagcattatacatgctagcaaaatcatttatttcttcttgagattttttatgtttggctaattttttatcaaatcgaactgcattagtggcaatttgtttactgtcttcagaactaagaccggctagagttaagagcttagccgattgcttttcgaaagtgttcaataattcttcagaagaaggatccttataagcggaggcatctggtaaaaatgaatttggtgaggcaaaatacaaagaattttgagaagtatttttcatatccgcatctacataaaaatagaggggtaaggaaaaagcatctttaattaattgagctaaattttggttaaaatcagagaatctagataaagaaagcagcttttggagatcaggtttgattggttgagcactatcagcatttctcttatcaaaatctaaagttagcttatacaaagtgatagctttgtccaaattatctaagtccggcaacttcttcttattaaaagcgaagttatcaaaatccttcagaagttgttttctaattttagtgtctaattctacgaaactgtccataagtggacgatcggctggaatttttgctttttcaagccactgtgaattagtagctaagtataagttgtcttgaagtttaacattggtatttgctacagcagaatcacctaagccaccacgaattctaaaagtattcataattaattactcctttaaatttaattgttgaattaagtctaacaaagaattaatattattttaataaaattcgtattcgaattattttgaggtgtaaaagatgactattggcgaattgcttaaagactatcgaataaaacaaggtaaaaatcaaagagaatttattgctggaattgttagtcagtcatattattcaaaagttgaaaaggagatacatcgaattaccgcagatgatttgttggaaattttaaatcataacggaattccagttaaagaattttttgaaaaattagaaattgatccaaatcaatggcagattgataaaattaataaactcatggaagaaataactaaagctagttattcggagcaggcaatagatcaaataagaaaaatcagggaaaaggtgaaaaagttagatttgaatccagaattaaaagaggaggctctattaataattgacggatttatagaattagaaaaagatgatccagaaacttttgatgaaaagttgagaactaaattaaaagaaaagatatttatgatgccagaatataatacacataagctgtctctttatgctaattttatagatttatatgattttgatagcaatttacaaataataagacagataaataaggtattagaaagaaaaccaatagagaggcaagaagagatcctatttgcaattgtattgaacgtattgggacaagctgttaaagagaaaaagtatgataagacagatgaaattattaatttaataaatcaaataaaagtaatccccgaattctttttttatcgtgaaatgctgactttttatgaagaattgattacatatcattttgataaaaaacaagagcatataagaaaatgtaagttgattttagaaagctgtgaatggggtgggatgcaggtatacggtgaagaaatgaaaaaattttttgatgaatataaagatcaataagtcaaaaaatctcttgaatcagcacgactcaagagatttttagatactataattttttcattagatgttatatgtgaaaaactctctttcttccaaaaaaattcaaatacgactattttaaaaataattttaattccttgataatattaaaacaacattaaaacatatgaaaaacggagttaaacattatgaacgtatttttgaagaacaaagattatagaagattttcagtcgctagtttcttatctagtgctggtgacattcttttttacttagcgtttatgacttatgcaagtaaattacaaaattattctcttgctttatcattaattgcaatctctgaatcattaccaagattattcgatatctttggtggctacttagctgatagaaccagaaaaaaatttaagaatatcttcttaatgtctatagttagatttggcctatatggattagttggggtattgtttattaccaatgtatctcaatggggcttagtaattgcagtagtaattattaactttatctctgatatggctggtacttatgccggcggtttaggtgctccattaattgttgatttagttggagaagatgaatttgcggaagcagaaggctttaccaatggtattagtcaagtgattactactgcggctcaatttgttggatcaggattattacttttcttgtcttactcaagcttagctttcgttaatgcatttactttcttagcagctggcttgttatatgctagtgtaggagttcgtcataataaagataatcagcctattgaaccacaagaagtaaacgagcaaaaattctttgcgacaatgaagacctcatatactcaaattaagaaggcttcaggcttgttgtcagttgttttagtaattgcacttcttaacggtgcattaacttctatgggttcattattaccaattattatggcaggaaatcgttcaacaatgattatttccacttacagctttactcttgcagtaattggtttggtggtaagtgttggtgcaatcttaggtagtacttttggaccacaattatttaaaaagcaatctgttttctttatggttattgttgctattgttttaagtggagccactacagtagctgcagtgtttgctaatatttttgccattatgccattttacttcttattagctttagtagtaagtactgcttcgcttaaaatgcaacaatggctagttacgacaattgatcgtaagattttggcttcaagtgtaggcttacttaatacaattgtcatggctacttcaccagtaatgactaccgtgttaacaactatttcaggcttaggggatgttagatacgcattatttgtactcttagcagttgaacttattattttgtttgtcgcagttaaattgagtgttaagactaaagtaaacaaagaggaagttaaatccgctgttgtagtaaataagtaacttataaaattaaggtttaactaatgacgcagcgcttgggaatagattctctcaatatcttagggatacttgtcaaaaaaattctatcgtaaattgcaataataaattgaacacttaggctgcttgatagatttgatctaattctctttcgaagatttcatctggtgtgtggtatgccaggatctttcttggtaatgaattgcaccaggtttcaatatcaatgatctgttggagagaatagttattgatgtactctcctttaggaatgaatctgcgaataaggccattgtgcctttccacagttcccttatcacaagaagtattggatgagcataataaacaagagtcttagaaacctcctctaaattagctagatccgcaaactctgaaccattgtcagtagtaatcgtcttgaagatgtcattccagtgctcgctgtattgtttctgaagcactttaaaagctcgcatgacactggcaaatgtcttgtcaggtatgcaaataatcaagaattcacggctcatgcgctcagaaagtgttaatagaacctgatcgtccttggtcttatgccctaaaacaagatcgcattcccaatgaccaaattcattacgctggtcaatctctttaggccgctcttcgatgcttcgtcccagctttttcttgtttttgcgaacatgatggagcttgatattgcgtttaagcttttcaggcaaatcatagtttttgattgtcatcagtccttgatctacgtagttatacaaggttctggtactgactgtttgatgatgcgagaattcaccgatagctaagctgcgattggcacaaacgtcaagcgaccagccgtcctcaaagaaatgcttaatgacgtagctaataaagtctgctttcttcaagaagtccgatttgcgaccgcagtggcgacgattaacctgataaacgctttgaccatgatcagccttatagcgctgctgcttgccatgatagagagaaacagtgccacgtttgacctcatagctgatcgtagaaggagagcagccaagttctcgagcaattgctctgatagagtagccgtcttttaagcgagtttgaataataactcgttcttcaaatgacaagtgcttgcctttaacgtgttgattcatggtagaatgtaaagagtccatttgtgacctcgtttttaaatgttgtgtggtaactacattctatcaaacaggtccagatggacttttattttttacaaagtgttcaacttaattttacaatcggcgaattattttagataatttttcctccgtaaaaagaatgatgaaataatagctaaagcaagtccaaataataatacccataaaaatccgaacttattttctttgcctggcaatccacctacgttcattccccaaatactactaattaatgcagggattgagataataagtgcaactgagtcaagatacttcattaggttatttaagtgattatccatcattgctgaaaataatccattaattgattctaaaagatctcgataaactttgatttgcttagttattcgctgttgtgaaagaattagatcaatgattaggattgagtcagcaagatgctgttccttaaaaaactttgtgagggaattgatagatgtagtttggtcgttcattgtgtggttaaagtaaactagcgttttcattaaatcagttgcttgttttaaggattgagtttttgtgctagtacgtgctgcatgatctagctcatcaatagcttgttttatgttgtctaattccttgttaaattgatcattttgatatagcaattgtttaattaaaagcacttcaactgaaagtttagtaattgaagttttatcctgaaaaataggtgtcggtgatttttgtaaaattagtattaaatgttgagaattaaatatggcaattgttgggtaaagggagtcttcaatttcactttgtttagggtctaaattaaaggatacaaaaatatgtgcaccctttaatttacagtcgggaagagcgttaaagtgagatacttcagttgcagaagtttgcttagtgaaaatatgcgtatcacaatttattgttttttctagatggtttaattcagcagcagtaggttgaactaaaattataagtttagctgataaaagatcatgtgatattaactgcccctgattattgtacatagtaagcataaaataacctcgtactctcaaatttttagactaaatatatcataaagagaaagtataagtagatttaatgcctagtgatgaattatatgtttacaatatatgtatagaaaatattaatttttaattaatatacataacaagttattaaggaaatgttaagcttgcagagctgtaggcagtagaatatctttattgattagctcttgttatgattaagttaatcaatcataagtcatataaagattaaaaatagctagctaaatcaatcttttatgtatttttaggaaaggaagcctaactatgatggaagataaacatggaattaaagacaaagtagcaggtaaacttaaagaagtagaaggaaaaatcactggtgataaagctcgtgaggttgaaggaaaggctcaacaagctaaaggaaaggtgaaatctaaggctactgaagtaaaagaagacttagaataatctacttattgtatattttagaaataggaggcgatccccatgcttcactggatttgggttttgattgtcggaggcgtaatcgggttgattgcaggagccattactcataaaggcggctcaatgaactggattgcaaatattattgctgggctagtaggctcatctctaggcgaggctttgctgggtgcctggggtccgcaagtagcgggaatggcaattgttccatcgttactaggagctattattttagttatcttagtttcatggattatgacaatgctatttgggtcaaaagctcattcataaatcatatttaacacaatttaaaaattctctctcaaaagagcagtcttagtcgactgcttttttctatgggcggccttttaaattttcatagtataatggatgtgatataaaaatctaggtaagaaaagagataacaatgcgtttaatttcatggaatattgactcccttaatgccgctttaactagtgattcaccgcgtgcccaacttacgcgtagcgttttaaatacaataaaagaaaaagatgccgatattattgctattcaagaaactaaattacgttctacaggtccaacgaagaagcaccaagaagttcttgcagagatgtttcctaactatgactatgtctggcgttcttctgaagagccagcaagaaaaggctatgcagggaccatgtttttatataaaaacactttaacgcctgaagtaactaagccgactattggcgcaccggatacaatggattatgagggacgaattttaaccttagaattcgataattattatgttactcaagtctatactcctaattctggtaatgaattgaagcgattagaagatcgtcaaatttgggatgaaaagtatacagaatatttacaaaaattagataaaagtaaaccagtaattgcgagtggtgactataatgttgcccatactccaattgatttgaaacacccagaaaataaccatcataacgctggctttactgatgaagagcgtcaaggctttgataaattattgaagcttggctttactgatacctttagaaaggtccatgggaatgtagaaggtgtttactcatggtgggctcaaagagtaagaactagtaaagacaataactcaggctggagaattgactattacattgtttctgatagaattgctgatcaggtaactaaatcagaaatgatcgataccggagatcgcaaagatcattgtccaattatgctagaaattaatttataattatccacttgtggataagcaaagaagatcgtttaggtcttcttttttaatttagatgggaagtgaaggctgtggataacgttttaaaagaagcaattttaaatggtttatacgataaggataagaataatggcaatgaattcttaagtccccagttagtaagtaatgatcaagagaacaagatatggtttactttgcggcaagaattactgtcagctacttcttttacttgggcagttgcatttatttctgaaaatatgcttgttccatttaaattagtgatgtcggaactagctaaaaaaggaattagcggtacgttaattacaggtacttatcttggctttaatagtccgaaagttttcaaggaattaatgaaaataccgaacctgaaagttcggctaagtgaagaagctggttttcacgctaagggatatatttttaatcatgaagattatcaaactattttaattgggagtgcaaattttactaggtcagctttattgaaaaattgcgagtggggattaaaagtaacatctcatgaaaatggccaaatagttcaagaagttaataatcaaattcaaattgcgttgactactagcattccgcttaccaattcctggattagagaatatgagaaaaattggcaacctgtcaaaaagacagctatgcatttggcaactgatcggaaagaagatattttacctaataagatgcaaaaagcagctttaaataatttaactgctctagtaaatgaggatgcaaaaagagccctggtcgtttctgccactgggactggaaaaacatatttgggagcatttgcagttcgagaatatcaacctaaaaagtttctttatctagtacatcgagaacaaattgcaaaaaaatctttagagagtttttataagataattggcagaagtcgtgaggactatggtttattaactggaaataagcatgattttaataaaaagtatctttttggaactattcaaactttaagccaggacaaagttttagcgaaattggatccaaaagaattcgattatattttaattgatgaagctcatcgagtggccgctccaacttatcaaaaaattttagaacactttacgcctaaatttttactaggaatgactgctacacctgaaagaatggataagcaaaacatctatgaagtatttgattatcacttagcttatgaaattaggctaaaggatgccttgaatgagcagatgttaacaccgtttcactatgtgggagtagaagattatacggtaggcgatgaaataattactgaaactagtaaattaaaagacttagttgctgaaaagcgagttgattatgtccttaagcagcttgattactatggctattgcggtaaaaaagctaaaggcttagtattttgcagtcggcaagaagaagcacgaaagttagcagaattatttacgcaagcaggacaccctgcacaggctctgactaatgaagacagtcagaagaaacggatagaagtaactgagaagttagaaaatggtgaattagaatatatatttaccgtagatttatttaacgaaggaatcgatattccgtccctaaatcagattgtgatgctccgaaatacccaatcgagtattatttttattcaacaactagggcgtgggctgcgtaaatttccgggaaaagactatgtaactgtaattgatttcctgggtaattataagaataattatctaatcccaattgccttaaatggtgataagagccgtgacaaagaccaagttgttagagaaagtaaattaccgcaagttatcgatgtttcaacaattaactttactgaggtagcttcacaaaggattttagattcacttgaaaaaataaaactagatagcatgcgggaactaaaaaagtcctacgaagatttaaaggcaaaactgggtcgcgcacctcttttatatgacttttatcaatatggaacaaccgctccaactgtttttgccaaaaatcaccttttagcccactatggcgattttttaaagaaaatgggagaaaacgtcgagctaacagattatcaaagttctgttttatcctttgtaactaaggaattgttatttggtaaaagaccccatgaattattactcttagaaagctgtttaattaaagaaaaggtaagtgaagtatcctatctggaattacttgaaggaaaaaattgttacgtaaatgatgctgtactagattcagttgagaaagttttatccttagaattttttgacgtgaaacagggaaaaacaacgaaaaaagagcagtatggaaatgttcctttagttgaaaagaccggaacgcactatctattttcaagtcaactttcacaggccttaagtgataatcagcaatttaaagacctatttaaagatgtcataaaaacaggcttggcgctttcaaaagaatataattctgatcaacaatttactctgtataagcaatatgatcgtaaagacgtttgtcgcctcttaaactggcctaaggacgtttcagcaccaatgtatggttatcgtgttggtgaaaaagaaacgccaatttttatcacttaccaaaaagattcaaagaagaagagaagtgcccgctatcataatactttagaaaatggacatagtttgcgctggtatacccgtacgccgcgtcacattgattcagatgaggtaaaacggctgcttaatacaaaagatatgaaattacacctatttgttaagcaaagcgatgcagcgggaaaggaattttattacttaggtactgccgatatccaaaaggattctgttaaagaagaaaaaataggtttaaagcaaaagagtacagttggaatgaatctgattctcaagcatccgttaaatcaggcaatctatgatttgcttttcagttaagaattaagcatagtttaggataaattatagaaattcataataattatttgataaattttaagttgcgaaaatgaagggatgagataagagtgaaactaaaactagtctctttaattacgttattagcgttagttttgacaggatgcagttttcaaaacaaacctaatagagctaatgcagcacataaatactatgttgaaaaaagtgaaacgccgaaaaacaatctcaatgtaattccaacattatttttccatggtggactaagtaattatcatggagaagagaatatggtaaaagctgctcaagaagctggagtgactaattcggtcattagagccgatgtaaatgcgaatggaaaggttaaactgattggtactattccaaataacgctgttaatccaattgtagaggtaaactatcgaaataacgttcaacttgattttaaagaaaatggacgttacgccagaaatgtagtccagactttacaaaatgagtacggaattaagaaggtaaatatggtgggacattccctgggaaatacttcaattatgtatttctcctgcaagctgcccacaatccaaatttaccaagattaaataagcaagtctcaattggtggacattttgatgggcttgattttaagcagctgccaattgctattagacagcctgctaatcttcgagttaataatgaaggaaagccaaataaaatgaatgccacctaccgtgaaatggcgaaattacgaactctttatccaaccaaagaaatagacgtcttgaacattattggtaatgttggtggaaattcggatgggattgtaaaaaatgcttcatctctttcattagaatacttagttgctcctatggctaaaagctatcgtgtagtcacaataactggcaagaatgcggaacatggtcaattaacttataataagcaggtagagaagcagattattaattttttatggctacaataacaaaataaaagaagatgtttgaaacatcttcttttttaaatcttattatcatgatgattctttttatcaaaattgtgaagccagataccccatgcggcttgaaattcgatgattaatacgctagcagagatgagtactaagagaattaaggcataactagcggtttcacctaattcagaggtatcaaaaccatatgtaaagagtttaccgcctccatacataatcaaaattatccaataaatatttgctagccaccataattttctcatttagataccgctttcatttcctatatatagctattgtagcactcttataggtacttaaaagtttactgcaaggctattaggagaaagataagtgtataataagtagaaaatagagaggcaagtgaactaaatgggacaagcttgggataaatttaaagaaaatacaactgtgcatcgtcttgtgaccctctgtttaattattctcgttttatatgcagctcgctcgatgatgaacaccatcttgctaacgtttatttttacatatttaattgtgcatttaattcgatttactcaaaagaaaattcctagcttacccgcgcaggtaattgtagttcttgcttatctcttagtaattgcgattatttactttgcgattacgatctatgtgccaattttaattaagcaaattataaaaatgagttattctctgatcaaattctatcaatcagatgatatgaactgggtatcacgctacttaagtcattacattagcaatagtgaaattacaacacaggcaaaacatggtgtaactattctagttcatgctttaactaattttggaacattaactatagcgttctttatgtcgctgatcataagctttttctatacgattgagcttaattcaatgactgaattctctcatacttttttgcagagtcgtcacttatcctggctatttgaagatgtcgcatattttggcaataagtttgttaatacttttggtgttgtcttagaagcgcaattttttattgctttatgtaatactacgatgacaatgatctgtttaattattatgagaatgccgcaaattatagctctaggattgatggtatttattcttagtttaatcccggttgctggggttattatttctttaattcccttgagcttagttgcttattcagttgggggactgaggtatgtaatctatatctttattgtgattatgattattcatgccattgaggcctatattttgaatccaaagtttatggcaagcaaaacagaattgccgatcttttataccttcgttgttttactagtcggagaacactttttgggaacctggggtctaattgttggtgtgccgatctttacatttttactagatatcctcggggtaaaatcagttaaaaagaaaaagccgcaaattttgaaaattgaagataaaaaataaagcagctgtaaaagctgctttttgtgtattgtaaatatgattgtaggatatatgagattatgaatggagtttggttattcacaatacactattaattacgcaaataattgtttttttataaaaatcccgagtacttatgatagcggtctcatgtaactttttgataaactgaaaatgaaagaaagatatgaggcgacgttatgaaaaaatatgattatataattttaggaactgggcctgccgcttataaattagttaagctcttagatacacaacataagtctattttaaccatcgaaagtggtttgtttggtgggacttgcccgaatgttggctgtgaaccaaaaatatatttagatggagcagttcaagcagttttatcaaatcaacaatttgaaaaagagggaataatttctcaaggcggaaaattaaattgggctcaactaatgaaagacaaaaaggcacgatttgcaagctggccaaatgaaacaagaaaaaatattagtaaaatcagtgatgtaattagcgggagtgcccattttgttgatcgacaaacaattgaagtaaatagacaatatttccagggaaatagaattataattgctaccggaagaaggccccatgagctctcaattccaggagcgaagttcttacacgatagttctgatgttttatctttaggcacattacctgaacacactacttttattggcggtggttatgtagcaatggaattagcgacatttttagctgctgcgggtagtcaagtaactattttagtgcgaggagatcgagtattaaggcatttttatcaaaaatatagtcgtgaattagtagttagaatgaagcaacgaggcattcaatttgaatttgaaacggagccaactcgaattactcaattaagcgataaatatgttgttgaattgaatcaagacggtccaattgtaactgactatgtagtgaatgcgagtggacggatgccgaatattgaaaaattagatttatcagctgctcaaattgattattcaactcgaggtattgatgtagaccgccaccttcaaacgaacgttaagaatatttatgcaattggagacgttacaagccaagatgtgcccaacttaacaccggttgcagaatttcaagcacaatacctctttaattctcttgaaaaggggcttactcaaccaattaattatccagctattggaacgggagtatttgcttttccgcaactagctcaagccggaatcaatcctgatagtgttcttgaagatggagataattttgaaattagagaatacgaactaagccaaagtagtttatatgctggtcaaaaggagaagggcttgttaactgtcgtttatgataaagccaattacattgttggtgttagtgaaataagtatgagtgcagttaatgatataaattattttgtaccaattattggtctaagaattaataaaaatgagtggcatcgaaatgtgttgccaatttatcctgcactggccgataaaattgaaggaattttgagatagaaaaaagcaccttgtggtgcttttttattacaaatctaaattttataagtcgctaccgccatagtttggagcttcttttgccatttgaacatcgtgtggatgagattcacgtaaaccagcattagtaatttgaacaaattgactattttcaattaattctttaattgtacctgcacccacatatcccataccggcacgtagaccaccatcaatttggtagatgatattggaaacatcgcctttataaggaactaaggcttcaacaccttcaggaactaatttatttgcttcattaactccaccttggaagtaacggtcagatgatccatgttgttgagacatagcgccaactgcacccataccgcggtaggatttgaattgtttgccttcattagtaaagattgttcctggagcttcagtagttcctgagaacattgaaccgagcattacagcatttccacctgcagctaaagccttaactacatctccagaatatttaataccaccatcagcaatgattttcttgccatatttttgtgcaacactagcagcgtcataaatagctgtaatttgtggaactcccacaccagcaacaatacgtgtagtacaaattgaaccaggtccaattcctactttaacaacatctactccggcatcaaatagggcagcagttccttcgccagtagcaacatttccagcgatcaatgtagcattaggaaaatgctcacgaatttctttgattttgcgtaaaacgccagcggaatgaccgtgtgctgtatcaataacaattgcgtcagcaccagcttcaagtaaactttcagcacgttcaaaagtatcacttgtaacgccaacagcagctgcagctaagaggcgaccttgatcatcaactgcagggtgaggtaagttaggatctacagttttacctttagcttttttaacttcttcaacttggacttcgattgaaaggtttttatgaataacccctaagccgccattttcggccatggcaattgccatgtttccttcagtaacggtatccattcctgcggaaatgagtggaatatgaagttgaagattgggcgctaatttagtatctagtttaacttcattcggcagcacatgactttcagctggaattaaaagtacatcatcaaaagttaatccttttttggcaaattttgtttcccacaaactcattgtaaagtcctttctttagaagcaacgttttaatattaaattagctaaactttactcgaatatctggcagaagtcaattagaaatttgatttaatttttgaacaattaattttgcgagtagttcatagcccttaacgccaaaatggagtccatcattctttttaccattgaaaatttctggaaaatttttacttgcctgcatcttacttgctagagcaataaataaaaatttatattcctttgtaacgcgtttgattatgttgctatattcctgcactaagaggttatttcgcactttttgcttattttcatcaactgcaggtggggtaacaaagataacctttcctgggtaataacgccaaataatgctagaagcaattaattttagattatcctcaaattgttgtaacgggacttgcttgtgtactgctaagtcattagtgccaactaaaatgatcagataatcgcattttggctgattgaatactaaattgggtaaagagagggcaagaccaccagaattgattcccgagatagctgtattgtaaatctgatacgaatttagtttttgcaattgaaagttaatttctggaatagaatgattttcagagcgtgcaataatactgtcgccggtaagaagtaatttcattaataaaaaatcctttagggtagaaaaaagaccttgagaaaatctcaagatctttttgattatcataatttgatttttagaacttgttcttgtccaaagcaactggagaatctggtttttcaccgttgatcatctttaagttgttgtcaaatgctttagttaccatgttacgtacagcatgagtagtgtagaaagcagtatgtggagttaccaatacatttggacgatcgattaagtcagctaaacgagcatctgggaattctttaccttcccaatcttcgttaaatacaccaacttcaccttcgtaagtgtccattacgaaaccaaagatcttaccagaatctaagccgcggataacagcgtcagtgtcaacaagtggaccacgtgagcagtttacgattacaacgccatctttcatcttagcgattgattcatcattaatcatgtgaacgtttgctggaacatctggaacgtgaagtgaaattacatcagcttgcttgtataagtcatcaagtgagtcaacgtagtaacccttcttttcaagttctgggttcttgaagatatcgtaagcaataacttttgcgccaaagccttccataatcttcataaatacttgaccgatgtgaccagtacctacaacaccaacaacttggtcacgaacttcacgaccaatagtaggtgcccagcgtaagtcgcgcttagccatcttttcatccatacgcttatcttgacgtagtacgcgagcagcttgaattgcagcatgttcagcaattgcgtcaggagagtatacaggaacgttagtgatttcaaagcctaattctttagccttgtccatgtcgatgttgtcaacaccaacgttacgtaatgacatcttagttacgccagcatcagctaaagcttgaagagtttcaggagtgtagtctaattgttggtaaacaacaacaccgtcagcacccttagctaatttagcagtttcaggggctaaaagcttgtcagtgtattcaacttcaatatccttgtgtgcatctttccattcgtttaagaaaggttcttcatctttacgaatagcgtaagcaaaaatctttgtcataaattaaacctccgtcaaaattaatagtatgaccgtcttttattatacacttgagtttgttaataaaaacacaaaatctaatttttttgaaacttcttttaaagatgtttcatgtgaaactattaatgttataaaaaattaattttcttttgattatgaatatagggtgccttatgataatgattagggaaaaataacgataagtaagctactaatatgttattaaaatttgatcaagatagatgagggaataagtaatgtcagttgttgttaaatatgttgacctagatgataatttggttgaacttgcaaattcaggagagctagagggaagagtaggagaaaaagtagattatagtacaaaagacgaagtaacaaaattactagctgctggttatgtgctgattaataatccttttgatcaaaacggtgaaataaatttttttaaaaaagattctcaagaatttacgatcacttttaaacatggaaaagaagaaataacagccaaaaatttaaaatatggatgtaaattagaggatgttcaaatgaaaggtgaacaaagagttcactatattggacttgaaaaaaatattcctgataaagttactgagattgcttttaatcgaaagattatttttgacaaagttactaagcaaaaattattaactaatacttggcaaccagaaaaatatttctttcctttagttgcaagtcccagtgttatgaactatacacctgataaggcagtaattggcggagaaactggaactagtcaaaagccaaaacatgaatatgtggtcacttatctacctaataagaaaaatgcaagaagacagaaagccgaaataaaatttattgatgttgataataacaaccaagaattagctacttctggagaactaaaaggaaagcctggaaaagaaatttcttataatacggcggatgttttgaaggatttaaccgctaagggatatgaagttgttactaatgattttgatgctgaagagcagaagcctgtttttggaaatagtaaagattatgttcaaatcttttttgtggctttaaaacacaaaaaacaagttgttagctccgaacatccattttcaggaattgatgcaaatctttatgaaaaagaagttcatcggacaattagtttctcaggaatagatgataggaagctagatgatgtagttcaaacagccatcttgaaacgcagcttaacaattgatctagtaactaaaaaagttatttcaggcgaatatacaagccaatggcagagtagtgaaacttatccttcagtacctgtgcctgtagtgtcaggatatcatactcaaattagtgaagtagtagcttcaccggtagaaaaacatgatttaactgaagaagttaagtaccacaaaaatggatacttgattcctgtggatgtaaatcataatgagttttcgaaaataaataaaaagcaattaattactaattcgattgatccaactaaagtggttcttccagaattagatttagaaaatattgtcttaaaacaaatcaaagaagtaaaaattgaagatccaagtcataattatcaagttccatatttactagtgcataaatatattgcagtcgatgaaaagcatccgcacgaggtaatcaatccagcgtactaccgtcgaattgtcactgctcgtgttcattatcaaggagcgggtaaacagactcctccagatgcagaacaaacggtgcgttggacaagaacaattacttatgatgaagtaagtaaagaacttattgaaaatggaatgtatacgacaaaatgggtagctgatagagatatttttgaagcaactcctacgcctgtaattaaaggatttgctgcaaatattggtttaataggtgaacacccagttacagaaactgacttaatggcgaccattacttatactccacttggaaaaatgattcctgttgatgagcatggaaatgaaatcaaaaatgctatgcatccaacttatgttaatgatccatatgatcccgtacgtgtgctttttactgaagaagtaccggaagtgccgggatatgcaccagttcacgatacaatttctgttaatgatccttttacagatattaaagtgtcgtatactttaaagcctcgctatattccggtaaatagtgaccatccttatcgaccgattaagcctacattgtacagcgtgcccgtcaaggaaacaattaaatatcaaggtgctggtgaccaaacaccagttactcgtttgcaagctgcatgctggacgcgcactctgactgtagatgaaaatactggtgaactagtcgaagacggaaaatacacaactgcttggtcaattgataaaaagatctatacggcagtaccaacgccaattattgatggctatcatgctgataaaaagataattgaagaaaaagaagtaaaaaaagctgatgtcgatttgcaagtgacgtataagcaaaatgggagaattattccagtaaattctaaaggaaatcctataaagaatgttgtccaaccactatatgtaaccgaggcggatgatgcaactaaagtaaaaaggatacaaggagtacctagaattatgaattatattcctgaaaaagaacttattactatagaggatcctgaaaagaatacgcgggttatatattatacattcagtgaaatacgggaattaagcgaaaagaagctaaataaagaaaagcaagcaaacttaaaaaatgatagtttagagaaaagagaagagaagaagaaagttgaaaaaatagaagaaagaaattttaaaaaagatgaaaagaaaataagtaaaagagagacaggcataaaagatatgttttcttggtttaagtagttatataacaaactaggcttataattcggttagatgagtctagttaaaacaataaattaatttaaaaaaccaaatgatgttaaagaataatttttttctttgatattgtttggtttttgttttgcatttgaaagctcttgacaaaataaaaaatgggggggggggtaaactaggcttgtatctactagttaggttgaaacaagttatttaatttagttaaaaaatggaagaggaggttgttaaggtatcaacttcgactttatagaaggtattagtagtaacatataaccctttgctaagcagcttgttaagtaacgacaaaaaaattaaaaaaaacaatctcaaagactataaaataacaaaattcatttttaatgattttagtgtataaaataatatacaaatttttgaatattatcatataataaacacattattttatatataaaaacaatgaaatacagtaaaaatcagcaattaagcaagaaaaatactgattaaataacttctagacctattcttgtaatgaaaaatatttgttataataacactaaagatccgatagtattactaaaatatattaattatataacagttaaatggaggaaaataaggaatgctatctaagaataactaccaagaacgcttaagaaaaatggatgacaaacaagaacgtttttcaatccgtaaattttctgtcggtgcagcttctgttttagtcggaacagctgtattaactatgcaaaatgttcaaacagcacgcgccgatactacttcaaatactacaactaagacaacagatttatcttcagaagctgaagaacaaaacaagcaaaatgcttatgataaaactcttaatgaggcacaacctacaactaagcctgcagatgctcctgtggagagtcaagatagtaaggtggcctcttttagtgtgcctaaaaatgaaggaacatttgtagaaaaaacactaacgcctaatattactgaagagacagaggcaatgcaggataaggctgagttagctcaagtaaatagtgaggataagtcagctgaaaacaataaaactaatgtaaaggaagaaagtcagactgttgaagagaatcaaatggataagcgatcagctgaagcgaatatatcggatacagaaaacacattagtaagtaacacaactttaaatgtccctaagacaactccagctactacacgcttttcagcaacagcactaagtgagagcaaatttcaagtcaatgctccacgcgtgggccaagatactcctgatacacaagttaagaaaaataattataaacttgtaaccaatgctactgcacttcaacaagcaattaatactggtgttgcaggtgttaatattgatagaagtattgatgcttctaatgttgatttggctattagaaatacttttacaattgttggtcttaacgatgcagcagcacttaatttaggtcaaaaatctcttaataattccggtaatttaactctccaagatattaagattaatggatcaatctctggtagcggtacggtaaatattaagggaaatgttacttctaatgtaaatagtactaattcttctgttccaactcaggatcaatataatgctcaaaattatactggtagtagaactaactttaagaactctaacattgctgctaggaacgtaaatattgaaaatggtgcttccttaactattaacagttctgaaattaatgatggaattaacttagctgatggcggtactgttaaagttggcgataatgctactttaaatgttaacctgactaatacatcaactactgctacccgttaccatgttgctggtgtgtttgccaagaatggtggtaactttattagtggttacaagtcaaatgttaattttaatacaggattaggccaagctattgcgatcggagcaacccgaccaacaagtactgacgccgatagatacggtggttatggtacacgctcaagaaatgatggtccaacattagttcaattaggtgactcatcgacttttaactttactggacgtgacggtattatcttaggtaataatgctaactttatttctggagagaattcaaatgttcattttgaaaacaagggacgaggagttgctttagatttagctaataactcaaatatcgaaatttctaaacattccattacttctttccattctgttggcaagacaggaacgtctggtagctttgatggctataactatattggtgttaacgaaggtggtaatattactgttgacgaatatgctaccttccgtgtaattcttgaaggtcgtggcgataatccatgggatgacgtaatttccttagattctagaaatgctaacacaaatgctgctttcacttctaagacaggagcaattgttgacattcgtgatgataatactaacttttacgcagaacttatttcattcccactagggagtgcaaactcacgcattgatattcaagatcccctaatgcttaacctgcaacgctactctaatggtggagcaacgactggttggatggctactggtggtgacaaaatcaacacaacttcggcacaatatactgctaacttaatttatatgagtggtaataagggagtatttagtgttagtggtggggattacgatccatctaatcctaatagttccggctttgttgtttaccaacaaattaagtcagatggctcaaaacaaatctggctcaatgtaaatagcgttgatattccaatgaatggattccaaactaaagatatttggaataatcaagcaaacccagacgtatcaattgcaggtaatggtttaactgcaggtattaaagcgaaccaagttcataactttgatgggtctccactaactggtccgaatgcaccatactatggaatttcaacccaacgtgctagtcatcaaatttggattcctcatagaacatcattggaagttactggtgaacacaagagtactattaagtacgttgatgaaaatggaaaagaaatttttccagaaaatactcaatcattagatatgaaacgtagtctgatacttgatattacacaagataagattcaagatattcagaattatgctttaagtcatactgcagatgaaactttagagtacattaaaaacagtcaagcagtagttcaagattcaggttgggatttcactgatgctaatggtaaagctgttattgatccatatagtacaattgactcacctaaattggctggctatgctgcaacgatccaatcaacaaatgtttcaactttaaaggttggagcagatgcttctgcagtaactgctaaatttatggttgaaccatctcaagatatggttcaaaatggcgaattatcaactgcttacaagcaaaatggcactactggaattcctgcagattatgtaacagtagtcgtttataataaacaagcaacttatcaggcaggtaaaactgatagtaagagtgttgttcgtgatattaactacttagatggtaagacaggcaaaaagattccagctaacctaattaaagataatccagtttctcaaactgttactatgcaccgtactgaaattcttgataattcaggcaaggtaataggttatgggactattagtgaagatggtaagtcgtacacacttaacaacgattggattattgatggtaactgggaagctgtaaaatcaccagacttaaccactaatggttacaagacaccacgttttgaaaatggtgatatagccaaagtagttccagcagaaactgtaaatgaaaatacccctgatactactgtaaatgtttactacgaccacaatgaaatcccagttggtccagatactccagataagcatggggtagatttaaacgaattaactaaagatgttaacgaaactgttcactacgtatacagtgatggaactaaggcagctcctgatgttgttcaaacttctaagtggactagaactttaactattgatgcagtaactaatgaagtaatttccgatggtcaatataccactgattgggcaattcctaagggtgaaaagactgtttacgatcaagtagatactccagtaatcaaaggctatcacgcagataagcgtcaaatcaatgctacagtggttactcaaaataatattgaagagactgttacttaccaaccaaatggtaagatcattccagttgatccaaatggagatccaattccaaatgtaccaaccccaacttacccaacagatccaacagacccaactaaggtagtaccggatgaaccagtaccagaaattccaggattgattccaagtgttccaacagtaacaccagaaaatccaggtaaggatacgccagtaccatataccccagaagttccagctaaggatcaagtagcagttgttaactacattgatgcagatgacaacaacgcaatcatcactagctcaggcaacttaactggtaaagctggcgaaaagattgactacagtactgcttcaacgattgaagaactagaaaacaagggttacgtacttgtaagtgatggcttcccagcaggagcaacgtttgataatgatgacaatacaactcaaatctacacagttgtattgaagcacggtacagttccagtaacaccagaaaacccaggcaaaccaggtgaaccaattaatcctaacgatccagatggtcctaagtggccagaaggcactggtgaaaatggtgtaaagagaacaggaactcaaactattcactacgaaggagcaggcgacaagactcctagtgatgatgtacaaacattcgacttcactaagaagatgctggtagataaggtaactggtaagatcattgatggaggcgaatggaatgtaactagtcacacatttggctacaaggatactccagtaattgaaggctaccacgcagataagcgtaatgccggaggatctgtggtaacaccagatgacttgaacaagactatcacagtaagttaccaaccaaatggtaagatcattccagttgatccaaatggagatccaattccaaatgtaccaaccccaacttacccaacagatccaacagacccaactaaggtagtaccggatgaaccagtaccagaaattccaggattgattccaagtgttccaacagtaacaccagaaaatccaggtaaggatacgccagtaccatataccccagaagttccagctaaggatcaagtagcagttgttaactacattgatgcagatgacaacaacgcaatcatcactagctcagacaacttaactggtaaagctggcgaaaagattgactacagtactgcttcaacgattgaagaactagaaaacaagggttacgtacttgtaagtgatggcttcccagcaggagcaacgtttgataatgatgacaatacaactcaaatctacacagttgtattgaagcacggtacagttccagtaacaccagaaaacccaggcaaaccaggtgaaccaattaatcctaacgatccagatggtcctaagtggccagaaggcactggtgaaaatggtgtaaagagaacaggaactcaaactattcactacgaaggagcaggcgacaagactcctagtgatgatgtacaaacattcgacttcactaagaagatgctggtagataaggtaactggtaagatcattgatggaggcgaatggaatgtaactagtcacacatttggctacaaggatactccagtaattgaaggctaccacgcagataagcgtaatgccggaggatctgtggtaacaccagatgacttgaacaagactatcacagtaagttaccaaccaaatggtaagatcattccagttgatccaaatggagatccaattccaaatgtaccaaccccaacttacccaacagatccaacagacccaactaaggtagtaccggatgaaccagtaccagaaattccaggattgattccaagtgttccaacagtaacaccagaaaatccaggtaaggatacatcagtaccatataacccagttaaggatccagataaggtaactacagtagaaggtaaacaaattattcactttgtagatggcgataataacaagccacttaaggatccaaatattcaaacttatgaattcaagattactaatggtgtgccaaacgaatccagtcatacctttactctagttaatgtaccggtgattccaggatatgttgcagaaattaagtctgctggtggaaagacggtaactccagataagcctcttgcagaagtaacagttgtttaccataagatcggtaagatcgttccagttgatccaaatggaaatccaattccaaatgtaccaactccaagctacactaacgatccgacagatccaactaaggtagtaccaaatgaaccggtgccagctattcctggaaagacaccagataagacgacagtaactccagttgatccaactaaggatacacctgttgtttacaaggatgataaagtaccacctgctccaaatacacaaaaagctgtagttaactttattgatgttaatactggaaaaattatcagtacttctggtattttaagtggtcgcccaggagaagatattaataagttattctcgtctgctgaagtaattaagcaattagaggctgcaggttacgaagttgtttataatgcatttgacggcgatggtgtgactaagtactttgacaatgatggcaatacggtacaacaatttactattgctttgaaactgaaagaaaaagctaagacgccagatcccgttcttcctgatccagaagttcctgtagaaaaggaaactcgatctgaacaaccagttaagcaaaatgttgctgttcctactccagaaaaacctgtagaaaagaagactactgacaataaggaagtcttaccgcaaacaggtgctgatagtaatgaagcggctactattttaggtgccgtagcaacagcaattggcatgacaagcttgattggcgcaaagagacgcaagaaagatgataaataattttttaaattaaatatcttttttcaaaattagctagtaaaaaggcgttgagacttgattctcagcgcctttttttaatacattctatttataatagtggatccatataagaaaagacatacaatatataaagtaattcacgttaacaagggggcatgaaatatatggataatttaagtgagaaagttgcatcagtagctgtaaaatatacggatttagataataatctggctgaactttttacttctgaaaacttgacaggaaatattggcgataaaattaattacagcacagcagatgaaataaaaaatttaactaatcaaggatatgtattagttaatgatccctttgatagtaaaggaaaagaaccggtatttagtgaagatcaagacagttacatggttacctttaagcatgggagagagcaagttacagttgataatctaaaatatggctgcaagcttgaagatcttcaagtaaaaggtactcaaactgttcattatgttggcgcgggtagtcgaactcctagggatgaagtatcaacaattacttttaatcggattttagtctatgatcgtgtgactggcaaaaagattggtagtaagggctgggaaaaagttgagcagtcttttccagtagttgcggcaccaagtattttaggttatgttcccgatcaagttttagttggtggaaaaacagttactgctgatgaaccaaatcgtgaatacactattacctatcaagttaatgaacatatttcaaacaaagaacagaaggcagaagttaaatatcttgatattgatagcaataatgaagaaattgttgaatctaaaattttaactggggctccaaatacaaaaattgactatagtacaattgatcaattgaaagagttagacacaaagggctatgaagtagtaagtaatggctttgatgctaatggtgatattcaattctttgatacaagtgacgactatgttcaaacctttattgtcaccttaagacataagcaagtactggttaacgaagaaaatccacttgatggtattgatgagtcagaatatcacaagataagtaaacgagttatagcttatagtggtgctgatgatcagacaccagaagaagtggtacagcaagtaaactggagtagagatcttacagttgatgctgcaactaagcgaattatttctgatggaaaatacacaactgaatggaagccagagcaaaaaacatattcagcaatttctgtaccagcagtaagcggatatcatacttatataaaagaaatgcctgaggaaaaggtaagacttgctaacgtaactgaaaaaattagatatgtaaaaaatggctatgtcattcctattgatgagagcggacaaaagattgatattctacctaaattacgttttgtttcagataaaaatgatcccactctagtatctttgcctaaaaataatctaaaagatgagaaatacgagccagaatctgttgattttgcaaaaattgatccagcaaaagacatagaagttaagtatgttttaaggcataaatatgtggccgtaaataaagataattctcattttgatgttaatcctggtgcatatcgccggactgctacagctttagttcgttatgacggagctggtgttaagaatcctaatgatgcgatccaaacagttcaatggaatagagatatcacttatgatgaggtaacaaaagaaatcttagaagatggaaaatatactactgagtggaaagcagataaagagtactttgaagcagtagatacaccagtaatatccggttttacggctgatattggggttgttgctaagcatgatgtaacgcaaagcgatctttttgcgacagtaacttacaaaaagaatggtgcgattattcccgttgatgaagagggacaggaaatttctgaagctaaaccagttccatttcttaatgatttaactgacccaactagagtcttggcaacggaagaagtgcctgaaatagaaggatatcgccgtactcaagagactgttttaattaaagatccagtagcagatattaaagttaaatacattctaaagccacgttatgttcaagttaatagcgagcatccctatcgaacagttaagccgcatcattacagtattccggttaaagagacgattcattatgtcggagctagcgacaaaacaccagtagatcgaattcaaggcgcacgctggaatagatctttaactgtaaatgataataatggaaaggtgattaaggatggtaaatatactactgcttggactgttgataaaaaagaatatagcgcagttgtaacgccggtagttgacggatatcatgcagatcaatatcaagttaaagaacataaggtagagcgtgaaaatattgatgtggtagtaaaatatcaccaaaatggtcagattatcccagtaaactctaaaggtgaaaaaattaaccatgcagatcacccagtgtatataaccgacacaactgatgcaacgaaagttttaatggaacaaccggctccaagaatcttagactatatgcctaaaaattcatcagttgttgtcaaagatccaagtcgtgatacaaaggttatctattatacctttgatgaaataaaagaattagtctcagataaaaagttaaagactaagattgaatctgttgatggaaagtcaaccttgtcaaatgtagtctcacttccaggtgatgacaataagagaaaagcaatcgttacttttgttgatttaagtaacaatgcggttcaaattgcatcttctaatgttttaagcggaaatgtgggcgacaagataactgatttatacagtacagctaaacaaattaaagaacttgaacaggctggttacgaagtggtctacaatggctttgatccaaaaggcgcaactaaatactttgaaaaagaccaaaaaacagttgctacatttacagtagcagtagaaaaaactaaaaaagtagacgctaaagaagaaaataaagcggagataacttctaagaaggaagctacacaggcagatggacaaaatgagcaagatcataaagttttaaagcacatttttccatggatgaagtagaagataaaagagctagatttgattatgcaaatctagctttttttatttttaaagtttttagaccaattttgatgaagaagtgtataattaattttcgaaaaaactttttcggaggaaaaattgtgtctgataaaagcgagtctttgaccaaattagaagaagacgaaaagtataatcggttaacagcattgaagttattcgccatgacttcatcaatggttatctcagttaatgagttggctccatttggaaaaactggtccaacagcagttttttatttgctattagcaggcttaatatggtttgtaccaattacgcaaatggcaggagaaatggcttcagttgacggctgggataagggtggaatttttacttgggtaaaagggtccttaggagatcgagctggctggacggctatgttttatcaatggattcacattactgttgggatgaacacaatgatgtacgtaattattggtgcattatctattacctttgatactccttggtttaacactacaccaagtattagatttctattgatgatgataattatctggtcaattactcttgtcgaaatggtaggagttaagaaaataggacatattgcagagtggttatttggacttgggatagctttaccagtaattttgctaattattaccttctttgtatatctctttcaaggacgtcccctatatatgcatttaagctggaataatatctttccacatcatttaactggggctaccttagtagcttttgtgccatttgtgttggcattttgtggtggggaagcatctgctccgcatgcaaaatatttggaaaatcctaaaaagtattccactgttatgctcgctttagctgtgactgctatttcttttgacttacttggtagtaccgcaattggaatgacaattccgaaagatcaaattcaaaattcaactggttttgtctatgcctttggaaaaattttagattcaattggcttacccggggatgttattaagaagtttatcagtgtattactggcagctggtattattggagaacttggaaattggctcgctggtcctagtcaagggatgtttgaagctgctaaagaaggctatatgcctaagttcttcgctaaatctactgatcgtgacgtaccgatgcggttgattgttttacaaactttgattgtaactgcatctgcaattttaattactttcactagtggtaagaactctgattttgcttttaatgtttctttagctgctacgactgctcagtacttgatggtctacattttaatgttgatctcttacatcgttttaaaggtaaaacatggaaatctaaagcgcagttattatatgacaaggagcaacggcttaggggtaataattgcaattattgccctggtaataactgtagtagcattctttatttcctttatcccagcacaaggaacaccgactgaattaaagggcgtttatgtttggacaatgattggtctgtgccttatcgttacaattttgccactggtaatttatcattatcatcaccgatttaaacagactaaatataagcaaaaaaattaataaattaaacatttttacttgtaaaatataactaataatattacatttaaattgtattcaagttaatgtgtaaaggaaaagagctatggtaaatttgaggtatccatagctcttttgtttataatataaaaactatattaaggaaataaataatgaataacccagaagaaatacagcattttattgatgtattactcaaagaagatagttttgtgaaagcagcaaaaaagctctacatttctcaaccctatctcacccagttaataaaaagaatagaagaccgtttaggaacgccaattattgatcgggataaaaagccctatgcattgactcaagcaggcttactgtattatcaatatttagaaaatatttcttataacaaacaacaattaaataaaaaattagcccaatatacacaacctaataaagaaatcatcagaattggaattttagagagtctaggcacttatttactaccagaaatactgccagattttttaaagaaaaatcctcgagtagaaatgcagctttttgaaaacttcccaagagaaagtgaaagaaatttactgagtggaaatattgactgttatatcggtcaaaccccagaagcaattgattcaagcttagatattgtaagtaatggtggtgaaagatactatgtagtaatttcaccttcatctccgtattaccaggaaggaaaatttatccttaaaccagatgacttaaacctaaaagacttattacaagaaccttttgttttaagtgttcctggttcggctattcggcaccaagttaatggagttttccagcgatttcatttagaaccacgagttgttttagaatctaaaaacattattactgcaactagtctagcaattcatgggatgggattaactatctccactgctagtatcattaaaagaattggtgaaacgccaattaacctttttcccttaagctatgacttaattaacgttactttctttattgcaacaaaagctgaaaaaacaaaatcgcaagctttaaaaaatttagttgaagaatttaaaaagaaaaatttacagcccattattggataaggtaaatgagacttcacactatgtcagctataacaaatttgttattagtaatttgtaaaaaagatatttaagcctgtagatttaataacttataatttaggtgaaaatatttaagaaagggtagaaaaattatgaaatcaggaaaatacaacgtaaaagctcaaggacatggtgcgagtttcatgcctatggaagttactctttccgaaaataagattgaagatattaaggttgacgctaaaggtgaaactaagggagtagctgacgaagtatttagacgtttgcctgaagaaattgttgaaaatcagactttaaatgttgatacagttagtggtgctactatctctagtcatggtgttattgatggagtagcattggcaattagtgaagctggcggagatccagatgagtggaaaaaccgagctaaaccaaaggaacaaagagctaaagatgagacttatacaactgatgttgtagttgttggagctggtggtgcaggtttagctgccgctgctagaagtattcaacatgataaagatgtcattgtacttgaaaagttcccacaaattggaggaaacactagtcgtgctggtggcccaatgaatgctgcagaaccagattggcaaaataaatttaaagctttagccggtgaaaaagaaaccttagaagaactagcagcaactccacttgaagagattgatccagagtatcaagaagactttaaaaaattacaaaagcaaataaaagaatatgtagcttctggtgcggattatctatttgattcaaaattacttcatgaaattcaaacctatttaggtggtaagagaaccgacttaaatggaaatgaaattcatggtaactatgctttagtcaaagaattaatcgataatgccttggactcagtgcattggttaagtgacttaggagtaaaattcgatcgcagtcaagtaacaatgccagtaggtgccttatggagaagagggcacaagccagttgaaccaatgggttatgcctttattcatgttttaggtgattgggtaaaggatcatggtggaagaattctggccgatactcgagctgagcacttgattattgaagatggtcaagttaaaggcgttattgctaaaagaccagatggcagtacaatcactgttcatgctaaggctgtaattttaactgctggtggatttggggcaaatacaccaatggttcaaaaatacaatacttactggaagcatattgatgataatattgctactactaattctcctgcaattactggggacggaattaatcttggtaaagaagcaggtgcagacttagttggaatgggctttattcagatgatgccagtttctgatccaaagactggtgagctatttactggtctacaaactccaccagaaaactatattatggttaatcaaaagggaaaacgtttcgtaaatgaatttgcagaacgtgatgtcttaaccaaggcggctattgataatggcggcttgttctatttaattgctgatgacaagattaaagatacggcttataacacaactcaagaatcaattgatgcacaggttaaagctggtaccttgtttagagctgatagcttagaagatttagctaagcaagttggaatggatcctgctactttagttgagaccattgagaaatataattcttatgttgaagcaggaaaagatccagattttgaaaaatcagcctttaatctaaaatgcgaagttgctccattttatgcaacaccgagaaagccagccatccaccatactatgggtggcttgaagattgatacaggtgctcatgtcttagataaagatggtaagcaaattcctggtctatatgctgctggagaagtagccggcggaattcacgcaggtaaccgtttaggtggaaattcgcttgctgatatctttacttttggtagaattgccgcaaatagcgcaaatgatgaattagaaaaatagtattaatccattaaaacgttgtaaatactagagtttacagcgtttttttgctaaaatactaaaaataattgattttttggaggaatataattgaaagaagcgcaggaaaagaagctgacgacaaaacaatatttaattgtagcatcaatgatttttgcactattctttggtgcaggaaacttaattttcccacttcatttaggccagcttgctggtaaaaattggggaccagcagcaattggtttttcaattactggggtagttttacccctactttcactcctagcggttgctattactcgtagtaatggtgtttatcaaataggtttaccggtaggaaaagtcttcgctcttttgtttatgactttgatccagttaaccatgggccccttatttgcggcaccaagaaatgcgaccgttgcatatacggtaggggtagccccacttcttcctaagcaatttcaaggcggcggattaattatttttaccgctatcttttttgcaattgtttttgttattgcatataacgaaagtgacatcctatcttctttaggtaaaattttaaatcctatttttctagttttactatttctagtttttgttattgcctttgcccgtccgttaggtaatttaggaactgttcccgttagtaaagattatgctcaaggaacaatagtaaaaggatttttagaaggatataacacgatggacgctttagctggtcttgcttttggcgtaaccgtggtaacagctattaaagaattaattggtaacaatgaaagtgaaacagcaaaaattacagcaaagtctggtttaatagccgttattgctatcggagtaatttatactttgttgattatggtcggagcaatgtcattaggacattttggaataactagtgatggcggagttctgttatcccatatcgttagatactatgctggtatctttggtcaggctttattggctgttttagtatttttagcttgtttaacgacagcagttggggttttagctgcttttgcactagatttttccgctcattatacaaaatttagttataagggatggttaaccatcgcttgtatcggatcatttgcaactgcaaatttaggactcgataaaattattcactggtcgcttcctgtcttaatgttcttatatcctttagcaattgttttgattatcttgtctttattctcaccatttttcaaaaaagatagagtaatctatcgcataacaatggcattaactttaataccagcagtctttgatttaattacaaacttgccagcaccaattgctggaacgccattctacaatgcagttagtcgtattcgacttcagtatttgccatttgctaatgttggtctagcctgggttgtaccgactatcttagggttagttattggaattttagttcacatttggcgtcgtaaatctaatcgaatttaagaaaagctatggttcatttgaatcatagcttttttgttgggataataaatttggtgataaaaatgagtttaactaataaggtacctgaaaaagacgttcatgatttatttacacgagttgctccgcattatgatcagatgaataatctgattagcttaggaacacaaaatggttggcggaaaaagttctttaaaaaattaaaagtaaaagctggagattttgctttagacctatgttgcgggactggtgacttaacaattgccttagcaaaacaagtgggtccctctggcaatgtaattggactagattttaatcaaaaaatgctcgacttagctgataaaaagattagggggcaaaatttacaaaaagaaattcagttaaagcaaggggatgcaatgcatttgccttatacggaccaaagctttgatattgtaacaattggttttggtttacgtaatgttcctgatgcagatcaagttttgaaagaaatttaccgggttttaaagccagatggaaaagttggaattctagagacttcacagccaactaatccaattattaagttagggtgggagagttacttcaaactatttcctaattttgctaaattattgggtgctaatgttgacgattataagtacttatcacatacgacggctaaatttatttcagctacgcgtttaaaggaaatgcttgagcaagatggttttaaaaatgtaataataaccaaattaaatttaggtgctggtgcaattcatatcggaattaaaaagaaaatgagataaaatataaaataaaaactaaaaaggagaattttatgagaactggtactaaaattattactttagacaacggttatcacttgtggactaatactcaaggcgaaggtgatattcatctattagcacttcacggtggtcctggtggaaatcatgaatattgggaagatgctgcagaacagttaaagaaacagggacttaatgttcaagtaactatgtatgatcaactagggtcactttattctgatcaaccagattactcagatccagaaattgctaagaagtatttaacttatgaatacttcttagatgaagttgatgaagtgcgtgaaaagcttggcttagataatttctacttaattggccaaagctggggcggcctcttagtgcaagaatatgcggttaaatatggtcagcatttaaagggcgccattatttcttcaatggttgatgaaattgatgagtatgttgattctgtaaatagaagaagacaagaagttcttcctcaaacagaaattgatttcatgcatgaatgcgaaaagaataatgactatgataatcaacgctaccaagatgatgtacaaattttaaatattaattttgttgatagaaagcaaccttcaaagctttatcacttaaaagatcttggtggaagtgctgtttacaatgtctttcaaggtgataatgaatttgttattactggtaagcttaaagattggcactttagagaccaacttaagaatattaaagtaccaactttaattacttttggtgaaaatgaaactatgccaatttctactgctaaaattatgcaaaaagaaattccaaattcacgcctagttactactcctgatgggggtcaccaccacatggttgataatccagatgtttactacaaacacttggctgactttattcgtgaagttgaagatggtaggtttaaaggtgaatagaaaagtcgatgctgagcatcggcttttttatttactaggcaaataaatcgctttcattgaaataatactatataatttaaagcaaatatagttttgttttattttattcaaggagaaaatgatgagcaaaaataataaaattacccgattattagctgctacagctgtaattggcattatcggaacttcagctgctgcgtgcagtaataacgattcatcaaatcaaagtaaacaatctagtgtaaaaaaggaaactaaagataagaaaagtaatacagaaaatgcactaaaaaagagtcaaatcaagcttagccaaactgaagctttgaacaaatttgatgaaaaatacagtgataaagagattaaagaaataaacctaaagttagacggtaaccgatacgtttatgagatcgatggatttgataagagtaaagaatacgaaatgacaatcaatgctagaactggtaaggaaattaaatctagttctgaaaagcttgatctagatgaacacctacaaaaaggtttagatttagataaaacaatttcgcgtaaagaagctagtgaaatagcagaaaaagaagtaaaaaatagtgttgccaaggaatgggacttaaaaatggaagatggtaaggctatttgggaggtaacagtagagtccggtagcacaaaacatgaagttgaaattgatgctagctctaaaaaagtaattaggtcagaagaagaaaattaattaataaaaaggatatcgagcggttgacggtattgcgatatcaggctataataatagtcctttctaaaattaaacacttgtatacgacaaaagccacctgtttcaggtggctttttttgttgggaatataggatataaatttaaagaaactagtaagtcacaagactggttgaattcatcgtgtgatcatctagtttataggtctttaattcaaaatcatcttcaaaattacagtagtaagtcttgcttccagaagagtagcatgcagtataaacagtatattcgtccttgccttgatcgttgactacactgcctttgatcatggcaacagactttaagatgttaaagaatttagcgacgtttgctttttcacctttagcagttggatagtttacgtttaagtaagcagctttaacaaaacgatcggctggaatactgtcaccgggcagacctaagctaccagttcctacgccccaaggagcaactttttgcccgttccagctttgggctgtagcgtcatgtgggtttaaaccggtgtagttaccaaggttagtaaggtgccagttaaagtcagggctattagttaaaacgccaactttgtcatcaaagactttcattccatattgttttgaaacctcaacaataatggcttcgtcactatcactaatgatccagtgaagaggggcaaccgcaaatgatgtgttaatagcttcattcactaagttaacattctttaaagcttcctttacttcactaacatgagtaaagttttgagtaacccagagcataatttcgtaagaagctaagttgattttaccgtcaataggaccatcactaaatttagcaaaatgtgggaagtttaaacctgcaatacctaatccatcttcgttatagcagtcaaagtatgatggatagccatcaaccacaattcccattccaataacagcctttttagtagtggtgttatctaagaacttatatggaagaggataattacgcggcgtaataataacgccttcgccataatcctgtccaacatctagattacggccaaagtataaatttccttgatcatctgtgaatcttaaaccagtacacatttccaaaaaacctccttatttagcattagcttttgctgcttgctctgcaatatatttcttttgatatctcttaatttggataacggcaaatactaaaataataaaaccaattgcaacaaaggcaatcataaagtaccaagcgactgtaaagcttgcagctcctttaataatcccaaagagtggagcaccaatggcatagccgattgcataagctaaaccaacgtatccaagcatgacaccttgatctcttgaaccaaagaggtcttttgccatgaaggctgggcctgacatgtaactaaatacagctaagccgcaaaagatagcatagccaataccagcagctttactaatagatgaaccatatggctggaagctaataaagatcatcattagaatagataaaatatacatacaaccagcataggccattgattttgctgtaccaaatttgtcaaataagaaaccaccagaaatatttccgattaaacaaccaacaccgtacattgatccaactaaaccaacatccgttaaagaaagtttagtatcaaggaaggcggcatagtcttcatttaaggaagctaagcctaaaccaatgattaagaagccaaggctgaaaatccagaaccatttcatttgtaacacttgtttactagtccagcctttaaactctttagctttggctaaagcctcttctttcttgctttcagctagttcttcatcagaaacgacaatttcgtctttcttaggggttctaatgaagcaggcgataattacaccaattactaataaagcgacggcaaagataaagaatggtgccatagaggttaaatgaccggtcttagtattacctgtcatgtagtgctttaaaattgcttgagttgctggctgtaaaaagatattaccaatcgaaccaccgcagaaggcaattcctaaggcagccccacgtccctttgctgggaaccagtggttaataacccatggaacaccttggccggagtaaaaggttgaaccaaccatacaaatgatagcggcaatatagaagccaggtagctttgtactaattccaaaaattacgtaggcaatagcagaaagaccaataccaattaaatacattagtcggaagttaactttttctaacgccttaccaataaatggagaagcaactgaagcaaaaaccgcaccaaacgtaaaaattaatgtgtacgatgctaaggtaaagtggaaggtattaactaaagggtgaataaacaaaggctgaatattttgagcaattccataaggaatagcttgggttaacatacataggaaaaccatgaagtacttatagcccttgcttactactttatctttagtagcggcatcaggagacatgtaattaccctctttctaactaattacttatctaaaataatatttggcttgttcacgccaatatttttttgaatttgtttaattttaatagctgcaaaaattaataatataaaaccaattgcaacaaagaaaatggtacaccaccaagcaacggtaaagctagtggcacctttgatgacgccaaagagtggggcaccaatagcaaaaccaattgcataggctaaactaatgtaacctaagttaaccccttgtgctttggcaccaaataaactcttggccataaaagcaggtccagacatgtaactaaagaccgatagcccgctagtaaaggcccagcccatgccagcgtataagttaatacgatctccatagggatgtgtactgattaggatcatcatcaaaatagcgataatcaacatgattcctgcataagccatggatttagcggtgccaaacttatcaaataagtaaccgccggaaatattgccgataataccagcaatcccgaatactgaaccaatcatgccgacttccgttaaggataatttggtatctaaaaaggcagcatagtcttcatttaaagaagccagccctaagccaataattaaaaaaccaatactaaagatccagaaccacttcatatgaagaacttctttaccactccaaccttgaaattcatgtgcttttttttgagcagcttcatgccgattctttttaacttcttcggctgaggcgagaacctcatctttcttaggaactctaataaaagcggcaataattagaccaacaactaaaagagcaacggcaaaaatgaagaatggagccatggaagttaaatgaccagtcttggtattaccagtcataaagtgtttcaaaattgcctgggtaataggctgtaagaaaatatctccaattgatcccccacaaaaggctaatccaagagcaacaccgcggcccttaaatggaaaccagtgattgataatccaaggaacaccttgaccagaataaaaggttgaaccgaccatacaaataattccggctaaatagaaaccaggtagtttcgtactaattccaaaaattacatatgctcctgctgaaaggcaaataccgatcaaatacaaaattttaaaattaactttctgtaaagctttaccaaccattggtgaaactagagaccctacgacagccccaaaagtaaaaattaaggtataagaagccaatgtaaagtgaaaagtattaaccagaggatgaacaaataaaggttggattaattgagcaattccgtaagggatagcttgagttaacatacagagaaataccataaagtatttgtagcctttactgaccaccttgtgcccatcgcttggcagatcgtttgacatcgtatctctcttctttctgataaaatactattaactttataagttatatattattaaacacgtgagctttgactatagccacttatattgtcgtctacttaagtaagtaaatcaaaaataatgacttattatgttatttaatgaatgtaataaaaacccgtctaactttcctagaataaaatgaattacaaaaggaaaaagattgattatctttgctattaagcatcgatatatcaatcttttttagttcgaacagatagacttagcggtaggtagaaatttttacattaggaaagaattattaatcttttacataacccgcaatgtcatcgtagtcaaaatcatagtttaatttcttaccgtaggctttttcataagcccttttcttttgcatataatcaatgtcccgcattcttttagcgttttgatcaactgtaaggcgatcaactgggtagattgtcggtaagacgtgaagaatatagcgtgtcttgtggaattctctactatttttttccatttctggaagatcttgaatttctacaaagcaggagataatcggtaccttagccttagctgcgtagtaataagcacctttttgaagggggcgaggtttacggtagtcataccacatttcttgttcagggtagattaagacccatccctttttatcaaagactttctgcaagtgctttggaaattctcgccccaagtattggtagctttgaacaattggaatagcattaatgttattcattaaaaagccgaagaaacctggcaattttaggttggagtcttcaattacaacatagagctttttatggcagcgattagctaattttttaattggcaggctatcagtttgcttaaagtgattagtcgttacaattgcaccatgttgcggtcctttagctctttgtttgtctttgatttgggtatgagccattaagactaaagtatcaagattgataatagtttgggcgataatatttttaaatttatggctcagctttttttgttgtttccaataatcgttaactagtttgattctttcatctttagtaagaatcggatcgcccaattcaactttagcgtgcattttaccttttttaacggctgctttgatattttcgataacttgtgcacgattttcgccgataatcatagtttaatcctttcgcctttagcttttacgtgagcccaattattgggatcaacgacggtgctatcttctttttcaagcatatgatctaacttagctcgatcttcggtacgttcctcatcagtataattatctaattcagcatgtaattcttcatagaagggtgtttctttagcgtacttccagaagtaatcttgatattgaacattatcaaagtgccatggcttaaagaataagttatagtgaattaaacctggattaggaaggggttctgtattttcattaggcattgcatcccagcgaggatcaagatgcaagattcggccatcgccaatttcattcaaatagtcttgatctggagcaatacagtcaaaatgatacttctcaagcaagtccataaaatgaggaataaagccttcatctctaaaggccttagaatttaagacgagcattccagagttaatatactttttaggatcaaggtctaggacatctttgatatatttcaccattttatctacatattgaatagaagaatcagtacatgcgccaaataaattattgcctaattctgtattgtatagcttagcaatgtcatcagtgactactgtatcgctgtcgatgtagattgccttatcgtattgcgggaaaagatcaggaatgaagaggcggtaaaagatagacatggtgaaaaagtcagctcgaagataattttcttttctatcttggatcggctttactaatttctcatcaatgtggaagaattcaacgtgtacatggtcattacccaaagctgccaattgatcttggtgttctttagatagatcttggtttagaaagataactgtgtagtcattttctggattagaattcttaactaatgaatttaaagatactgcagcgtatttagtaaagtcatcgctaatactataaaaaactggaatagtcattttagtgcctctttatatttttacggacgtagtctttttaacttttgcccaagttacatcttcatttttaatttcatcgacttttttaatcatccaatcaagatcagcgcgggcttttttacgatcttcatcagtaaagctgtccaattgttcttttagctcatcatagtatggggattttttagcaacatcccagaaatattgaccatattgaacatctgcaaagtgccatggcttaaagaaaaggttgtagtgaacgatttttggatctttgatttcatccatatgttcattaggcattgcatcccactcaagcggtaagtgatagatcttatcttcacaaatttcattcatataagcttggtccggatcaatattgtcaaaatgatatttttcaattaatgaatagaatttatcaacgaattttttatctctaaattctttcatattgaataaaatcacaccattattgatgtatttttctggtgggaagatgccttggcattccttaatataaacttgtagcggtttaataaatctaattgacatatcagggacactcgcaaacatgttatcgccaatttcagtattgtagagttcagcaatatcagtgcagataattgtgtcggcatctaagtaaacggccttatcatattgcgggaaaagattagggataaagagacggtagaaaatagacatggtaaagaattgtgctcgtaaataattttcttcactattgtgaattggagctaccatttcatcatcgatatggaaaatattaacatgaacattttcagttgaaagatcttcgagactctttttatgttcatcactaatactttggactaaaagagtgattgtatagtccttctttggatcaacatgatcaattaaagactgaatcgaaacagctgcgtaaggtgtgtaattatcactaattgtgtaaaaaactggaatagtcattctcaaactccatctatataataatttagcgctgctttaaaagcggcttaagttctgtgtactgcttaagtaaatcatcatattcatgtaatttcaagacgctatgaacacgttctacatcccaaggtttaactgttaaagtgtggaagtagggtttaaagcgaaagctagtagtaaaatgttggatttttgtatcagaatggagccggtactgttcgttgtagcagcgaggagcaattcttttttcggtcgcaagtttatttaaggcagattggtcgggaaggagcatttttttatcgctcattttttctcgaacttttgcaaataatcttgtctttttaatttcattcatatttaaaagcaaaactccggagttaaggtagtcaaaagttttgtggctgtgaagattatggaagaaaaagcgaccccagaaatctaaaacaccaactaattccacattagttaagtcttggttataaaaatcactaatatccttacgtacaataatatcgtcatctaagtataagatgcggtcaggaatttgtggaatttgatccgcaaataacctaagcatggcataaggagtgaaacgagtctccatgttagcgcgtggaggctcttttttgaacaagtcagtacagtcgattaattcagcagtgttgtttggatctttttctttaatgatttttttgattaagttaaaagcttgctcatcaaaagcttcatatccttctgcctgcatagttaagatatagaggtgcaggggagcggaggtattttttaataaagatagagttgcaattaaaataccatcttcggcgtgagagtcgccgcaaaacataatattcattttagtctccaatttctcgtttttgatagtgataatattgatagtcgctattcttagatcgcttttttaattgctcgaatacttgatcatggagctttttttgttgctcttttttggtcaaggtagagtccgggaagaagggaccatcaatataaacagtaattttgggatgcttgccaaatttgcgtttttgataagttgtcgtcattacaaaacttgccttatttgcctgaactggaaaattaaagctagtttctggaaaggaccgaatgctggtatagtaaggccagacatgagcttctggatagattacaatatgagcattttctttagttaaggttttaacagctttaagtaatttaatagcttgtttaatatttttgccgactggtagacctccatagggcaggagcgttttcccaataactggaattccccaatttgcttgattagcaatggcatagtaatttttccagccaaataaggttaggggcatgaagacgtcattaaccatttgggtatggtttccgtaaataaaatatccttcatctttatatttagataacttatccctacctagtactttgacatgcattaggccataagtaaaaagataagcaaaccctgtagccaaaaaacgcatcagataattaagcggagtatgtttaattatttggtaattatcaggcagggtaaagtcttgccttttactttcaacaacgtcatcggttgtggaattatagtagatagtatgatgtttagatggtttagtattcatgatattaattatagaaaaaatttagaaacaaaaaaagacatcgcaattgcgatgtcttttcaaaaatatgggtggtcaggggatcgaaccctggacccacggattaagagtccgttgctctgccagctgagctaaccacccattggataaccaacagatactattatgccaaaaaaaaataaaaatgcaagaactttttttaagaaaattgatataaattaaattggctgtataatttttcctgttgatgaatatctatgatattctatcgacaggatttttttacgtaaaaaaagaggccatagtcctctcttacttaaaatccttcttcgaccaattcaattaagtgtatggagatttaaactatgtcctctttaaatgattatattaaatttactcttgatattgaagataaaaacattattttttctgattattcaaatgaaaatattaacggtaagatttacaaaatatatttagctgagctgatccagcctacttgtccttattgtcgttctactaatcttaagcataacggtcattacgtctctaacgttcgtttcattactgctgatgctagtaagcccgttactatcagattaagaaaacaacgtgttctctgcaatgactgtttaaaaagatctatggctcaatctaatctggttaataaaggctgctatatctctaacacttctaagcgaaaaatactttctgctcttactgaagatcgttcaatgaccagcattgctagagaacataatgtatctgtcaacacggttcaaagagtattagaagtctgctcttctaagttctatgatgcctttgatcatctccctgaacacttagcttttgatgaatttaagggcgtaggcaaaaagcttcactttatttgtctagatggtgatactcacaaagttgttcaaattcttagaactcgtttcaaacctgatattctacgctatttttacaagttcactcctaaagctcgtgcaatggttaaaacagtaactatggatcttaattgttattatcctttagttgctagagaattatttccaaatgctcagatagttattgaccgttttcatatggttcaaatgcttactagatcgtttaatattttcagagttcaaatcatgaagcaatttaataaaagaagccgtgaatataagcttttaaagtccccttggaagctttatctcatgaaatatgacaaacttaataagactactccttattacgactggcattttaaggactgtctaacacaggaacatgttgtcttagatggtttagattgtgaccaaaccttagaaaatacttattgggttatgcaggactttatgactgctattcaggataacgatgaaaagaaagttatccatctacttcattcaaaacaaaatgttggtaaacaaatgcatcaaactctattaacttttaaacgtaattattctggtgtcctaaacggtattacctcaacttattctaatggttgtcttgaaggagttaaccgtaagattaaacaaattgaacgtactgcttatggttatagaaatttcaaacatttattaattagaattagactcgaagaaaatattataaaagaaaaggaatcaaacagctatttcttagctgcttaattccttcttaaaattatccatcaacaggatttgcaaaagagccattaaattgaagaaaattagaaacaaaaaaagacatcgcaaatgcgatgcctttcaaaaatatgggtggtcaggggatcgaaccctggacccacggattaagagtccgttgctctgccagctgagctaaccacccattggataaccaacaaatagtattatgccagtaaagtaaagaaagtgcaagcttttttttgcataagtttaaaaaaagtggggaaaacagtataatatagttattaatactgaggaggcatcatttatgccaaagaagattttagtcgttgacgatgaaaaaccaatttctgacattattaaatttaatctgactaaggaaggctttgatgtcgacactgcatacgacggcgaagaagctgttaaaaaagttgaggaatataatcccgatttaatgattcttgacttgatgttaccaaaaaaagacggcttagaggttgcacgtgaagtgcgccaaactcatgatatgccaattattatggtaacggctaaagacactgagattgataaggtgttaggtcttgaaatgggagcagatgattatgttactaagcctttttctaaccgagaattagttgctagagtaaaggcaaacttgcgtagacgtgacttgactcaaaaagctactgaagatgatgaagacaaaaatattaccattggcaatcttgtgattatgcctgaagcttatatggttgaaaaaaatggtgaaaaaattgaattaacgcatcgtgaatttgaattacttcattatttagcacagcatatgggacaagtaatgactagagagcatttattacaaaccgtttggggctatgattattttggagatgttagaactgtggatgtaactgtgcgacgcttacgggaaaagatcgaagacaatccaagttcaccaacgattttagttaccagacgtggagtaggatattacgttaaaaacccatcagatgaataaggatcaaagtcactagtgatagtggctttttttgcaattaggaccaatgaagaaaataaaaagtgtactaaattctattaattttaaaatcgcaatcatttttatgttgctactactagcaacgattgaagtcgttggagcttcttttactagacaacttgaacaaaactcaattcaaaattttgagtcttcaattcaagtcccaaacattattactaaccaaattgccagtcaattgagtagggcaaacagtaagagtgctaatcagcagctaagccagattatttcaaactataatctcggcgatattagtcaattaatggtagtagataataagggcgtgatccgagctgtttcaaatgttaatgatcagaatcgaattggccagcggactagtaatgcggatataaaaagcgtgctttcaaatggaaaacaagtttctaaggtaatcaatgacaatggaaactatatggtgcaaatttcaccattaacatctgctaatggaactaatacgcctgtgggagctatttatgtaagagcaagtttacagggtgtattcaataatttacggcaagtttctatttactttttgattgcctcattaattgcggctgttttaggtgcagtagttgccttggtaatttcccgggccataactcggccgattgaagaaatgcgtaagcaagctttgcgggtcgcaaatggagattattcgggacacgtccgggtttatgcgcaagatgagttagggcaattagctgaagcatttaacactttgtcggtacgaattgagagaactcaagagatttctgatagtgagcgaagacggttagataatgttttgacccatatgacagatggggttattgcgactgatcgtcacggaaatattactatcattaatgaaactgccttagactttttaggcaaaactgaaaaagatgttattggaaaaccgattactaatttgcttggcttaaaagatgttacaattcaagatctcttaagtacgcaacaagaattagttgtgcgcgtaaatgacaatacaagagatgaaatgattttacatgctaacttttctttaattcagcgtgtaactggctttgtttcaggtctagtttgtgttttgcatgatattacgcaacagcaaaaaaatgaacgggaacaacagcaatttgtgtctaacgtttcacatgaacttagaaccccattaacaagcttaagggcatatgttgaagccttaaatgatggggcatggaaggatccaaatattgcacctcagtttttacatgttatccaagatgaaactgagcgaatgattaggatgattaatgatctccttagcttatcaagaatggatcgtggtgtagccaaaatggacttagagtgggttaacttaaatgattttgttaaccacgttctaaaccgttttgatatgatgctgaaatctgatacagataaaacgcataaaaagaagtattcaatcaagcgtgaatttcctcatcaagctttatgggtagaaattgatactgataagatgatgcaagtaatcgataatattatgaacaatgcgattaagtattcacctgatgggggcgttataacagttcgccttcttcaagctcaaaagcatgtcatcttaagtatttctgaccaaggattgggaattccaagaaaagacttaaataagattttcgatagattttatcgtgttgacaaggctcgttctcgtaagcaaggtggaactggactaggattagctatttctaaagaaatagtagaagcacaccatggccggatttgggcagatagtgctgaaggttccggatcaactttctacatttctttgccatatgaagcaattagtgaggaaggagaaaactgggatgaggtttaaagataaagtttctagagtggcactgcgtgttagcttaattgcaatggttgtcttatcaataattttatcggctgtcatttggggatcagatgctcgattttctagaattgaagaaacatctaatcaaacgcaaactaaggatctaggtcaacgttctttaagagacatctatctaccaacgcaaactttttattttaaaaataaaaagatgtatcaagtctatgatacaaagaacaatttacctttggagttttctaaattaactcagtctttaagacctctcttgccaatccgaatctggtctagtcaaactaagtatgaaaaaatgttgagaaatccaaactatattcagctaacatacccagatcagataacgatctcattatttttaactaatgtaagaaaaaatgatagtcgggaatttaatcgcatttttgtctcaacgacttctagcgactacatctatctaggtaatgatgagaaccatacactctattgcattcgtttaaacgatgtctcatttaagaccctaattgagcatattagaaacgctcaaactcaaatgccagtcactcttgaaaaggtgcatgatgactatttacctttctatgaaaaaaatctaagcttgccagtttatagctacttaactaatgaagaatctgattcatattttgtttatcgcttgttaggatcaaataatccgacccagcataataatggcaatacaattacctactctaatggagtatatgaacgtttaatagctgctaagcatactcataactatgaatatattgattatcagcaagatcaaattcctaagacaattagtcgaaaattaaatgatagtttatattttgtacgaaagattggtttatcagaaccagatttaagattctttgatgcagacgacaatacagttatctatcaaaattatgtcgaagaatatccaatctttttaccaggaaaatataagatgcgagcacaggtaaaatttgcacctaatgggatgacgattaacttcaatagtttagacttacagattccaattccaactaatggggagaagaaaactttaattccaactactgaggccatggatgagttataccaaaaaggatatcaccgaaaagatattgaaagaattattattggatacacagctaaatcttctaacagtaaaaataagaaattggtagatttagagccagcttattatgtaaaaattaataagcagtggaagaccttagatgaatggcttaatacaaataatcagttagatagtgcaggaaaggagggactagtagatggactttaaaagaattgaatggatatttttaattgtatttatcgggattaatatctttttgggaattgagttatggcaaacgccaactctcttatctgctggttctactccgactcagactgatattaagagtgagacaagtgctgatcaaattactattccgaaggttaatgataaacaagaagatggatattatttggcggctaagaatgatgactcgtggatcaaaaaagctactcagcaggtaaaaggacaagtagaaaataattcaagtgaaaatcttatttctgttcatctagataagccaattactttatctaaaaataaaaaagaagccctaagagaagtcatgcgttttaaggatgatagtcaaaatgtatatcaaggtaaaaactatacctacctttcagaattatctgagggggacgattatatttttaaccaaaagactaaatatggagaattttttgctgcaacagctcggcttcacattattgtaaaagataatcaaattgtttcttattcccaaagctatgttgatgacttaaatcctgtccgtgaacgccaaaatacaattagttcaaaagccgctgtagactctttatatacttacagtgaattaccaaataattctaaggttatcttgttgaagcaagtctatactaaattattaacagttaagggaaatactatttatattccaacttggttagcagcaattgaaaataatacttctaagacagtgaccttgaagcgtgtaaatgcatttacgggaacaattattcaaaataatgttacgactgatgattttaaggagtgaaaaatgtgaaagtatcagttttatcaagcggatcaacaggtaattctactttaatagaaactgagcaacacaaaattttgatggatgcaggtttatctggaaaaaagaccaaggacttactagctcaagtcggagttgatattaaagatattgatatgattttcattagtcatgaccataccgatcattcagggggcttaggagtcttaatgagacggtatccacaaatttcagcttatgcaaattcaggtacctggaattatttaattgaaagtaagaaaatcggtaacttgcctgttgaacagatcaatacttttgaatctggggtaacgaaaacttttggtgacttagatgtgactagttttgctactagtcatgatgcagctgaaccccaatattatgtttttagcagtggcggtaaaagatttgcttgtttaacggatacgggatatgtttcaagcaatgttaaaggcgaaattaaggatgcagatggctatttaatggaatttaattatgatgatatgatgcttagaaatggaccgtattcttggtctttaaagcatcgaattatgtcagatgtgggacatctttcaaatgatcaggcagctgatacgctacttgatgttgtttctccaaaaactaaaaacatctttttggcccaccgtagtcaacataataatactcagtatttagctcatgagactgcccgtgatttattaattgctggggatgcaaatctgcctgcagatgttaagattattgataccaatccactagaggctggttcactcacagaaatataatttttagcaaataatttgacttgaattcataaaaaattcaaaatttgtggttaggctagagtgaatagaaaaggagattttttatggcagaaaataatactaagaactctaataaacataatgctcttattaaaactggtattgtgggagtagttgcaggattactcggtggtggagtagcttatgcagggttgtctcaagttaatggacagaatgctccacaaactactgttgctccaacagctaaggttgaaaagtctaacagtaaaaatagcagtcagatgactaatgcctttaatacggtaaagaattctgttgtttctgttgtaaacttgaagagacaaagttcttcttcaactagtgacccatttggcatttttgggtctgatagttctagttcttcaaagaagaattctaaatcagatttagaaacttacagtgaaggttctggagttatttacatgaagtctaatggtaaaggctacatcgtaactaataatcacgtggtttctggaagtgatgaaattcaagttattttaagtgacggtaaaaaggtaacagctaaaaaagtcggaactgatgcagaaacagacttggctgtcttaactattgatggtaaatatgttactcaaactgcccaatttggttcttctaagaacttagagccaggtcaacaagtaattgctgttgggtctccacttgggagcgaatatgcaactagtgtaacccaaggtattatttctgctaagaatagaacagtagatgtaactaattcatctggccaagtaactaaccaggcaaccgttattcagactgatgcagctattaaccctggtaattcaggtggtccattagttaatatgtctggtcaagtaataggtattaactcaatgaaattgtcctcttctagtgatgggactgctgttgaaggaatgggctttgcaattccgagtgatgaagttgtttcaatcattaatcaattggttaagaatggtaaaattacgcgtcctaaattaggtgtaagaattgtatcagttgatgaattaacagaatatggccgcaagaaacttggtttgcctgatagtgttaaatctggtgtctatgttgctagtgtgactaagaatggtagtgcagataaggccggcattaaggctcgtgatgtgattactaagattgatggcaaagatgtggatagcgttgtttcactacatacagctctttatgcacataagattggcgatacagtaacccttcaagtggttagagatggaaaatcacaggatatcaaagttaccttaagttaattgaatattattaaatagaggcaaaaaagctatgattatacgatttgtaagcggtaatcatagctttttcttaatatttaaagcgtgaaacctaataaagttcgtattttaaaattgtcaagatgttagaatgatcaaatagattgtgggaaaatgtggaaaactctgtggattgtgtataagttagcaataataaaaataaaaatgtggaaaacttgtgaattgtgtgtaaataaagttctgatttttttaaagttgaactactgttcacgcccagtatgtaagggatagagcgaaaagtttggaaaattaactaaatttataaaaatgtggaataaattttgtaaaaaagttatccacttttttataaaccaaaatttgttgagaagtaattgagcgaaccactaaatatagtttgtagtaatccacagccgggggaaaactcatgtggacgctatgtcaattaggggataaaataaaaagctagatgtgtgaaagggataaattagtatgaatataaaaattgtctgtgtagggaaattaaaggaaaagtattttaaagatggaattgcagaatatgtaaagagaatgagtcgttttgcaaaagtaaaaatagttcaagttccagatgaaaaagcccccgaaaaactaagtcccgctgagatggagcaggtcaaagaaatcgagggaaaaagaattttagataagataaaagataaagaatacgtttatgtgactgcgattaagggcaaggaaagaaccagtgaggcttttgctaaagagttatctgatttaactacttatgggcattctgacatcacctttgttattggaggaagtctgggtacaagtgacgcagtaaataagcgagcagatgacttaatcagttttggtaaatttacaatgcctcatcaattaatgcgcttggttttaattgaacaaatttaccgtgcatttatgattaatagcggcagtccataccataaataattatttgagaagaaacaagattggttgaagtagtactatgatgctactaaaaataagccagtctttttttgttaaggcgatcggaacaattacacttctttctttgtcttcacgatagccatgtgaaatcattccatcagctaaactattagaccaagaaattgcggctaaaattgctttaaaatataaggccggtgagtagaaagataaatggtagtgtctcatatccccaactaggcggattcgattcacttcggcatgaattttgggaataacattaaaggcagctagagttccataagcaaacttactaggtaatttaaaattttgttctagtgaacgagctagagcaagaaaagaagtcgtttcagtgaaagcagctcctaaaaagacataggcgtaaattctcgtaaataagacacaggcttgataaagactgcgactaggagtgaagtagtaaattgtaataaaaactacggaagccgcaaataaaggaatgataaataataaaaatagcttcttaagattaatgtgcttaaacagaagatagataagacaagccccgataataatgaggtttgctcctaaattaggcacaagtgatatttccagagaaataattaagattaaaaataattttagtccgggattcattttatttacccctatttagcgtagaaaagttgttggtcttttaaaacaagatgatagtcacatagattttgaatctgatcgagctggtgactaattacgattaagctatggttttcatctaagaagtagttctttagtaaaaaaatgacttctgagacgcttttttgatctaaaccactaaatggttcatctagtaataaaacgtccggataggccattaacatgacgagaatttgaagcttccttttttgaccaccagagagagaataaacgacttgatcatccatattttctaaattaagtttagttaggatagactgaagtttagactcatttaaagaaggattttgattgtattttaagctaaaatctaattcttcttttaccgtaacatttaagaattggtcgtctggattttgaaaaatttgtcctacttttgacaaataagggcggcgacgccattttttaacctctttatctttaaagagtagttctccctgataagtaataaccttgcttaaggccttaaataaagaagttttaccactaccattctctccagttaagagggttgctttcccagaatagatttttaaattagttgaagaaagtaactctttttctggaaatgatagtgaaaaagaattaaaagaatatactgattcttgctttggatgaggaagagaaaaattggttactacttcttcttgagaaggtagaggagtagtttgaattctttgatttttgatagcaaaaattttgggatcgattttttcataattagcaaagttatgatcactaatcaaaatcgttttaccttcttgatggagtgaatctaagcagttaagcagaaaatttcgattatgagagtcgcaattagcaaatggctcatctaataagaagaggtcactttgcattgcaattaagacggctaaggctacatgctgcttttcaccgcctgagagatgaaggaagggacggtctaacaaatgcgaaatattcgttttatggctaacctcatcgataatcttttgagcagtaactcgatcaattagtctattttctaaagcaaaaattaactcttctcttggtgttgccatggtgaattgacgattagggtcttgaaagaccataccccaattagtaaatggctgatttaaagagccagtagtaattttgctgttagaagtaggttcaagaccagcaactaattttaaaagggtagattttccgctgccacttggacccgttaataagataaagtcgccttggttaatagtaaaatctaaattcttaaaaattaatttgtcttggtattgaaaagagagttggttaattttgatttgtttggatgacatgagctttttctaaaagatttacgattaattttactaatacacaggtaaataagagcatggagatccagcgaactacaaagtagagaatcatattaaaggttgaaaaatagctatagccattttttatgaaatcgtacaaataagtgataatggttgtggtcgtagcagataagaaaagcgtaaaccaatcatatcgacggtagctagtaaaggtaaaacctaattcactacctagaccttgaacggcaccagaaattaaattaacagctccccactgttccccagcaatcaattcaacgcaggagcctaagaattctcctaagaaagcagagccagggatgcgaacaagaaagcctgctaatggtcctgccatacaccaaattcccatcataatgtcattagctaacatcccatagccgattggagtaaggagagctgttagggcgttatagagaccgtcactagctaaataaataaaaccaaaaataatagcaattaaggcaattaagatgatatctcttacatgtaattttttcattttttcctccaaaaataaaaagccaccttaaagaggtgacttaaataaaagtctaaaaatagtcattttccctacgctgatattaatcaaacaggttcaatgggtatattctcagcccgataggcaccccagatgtatttacagtttaagcttacgcttaataagactaaaagacaattaaaaataataaaaaggttataattaaaacagaatagaatcaaaggggactgattgagatggcaacagcgacattaaaaaattatttattaagtttaatgcaaaataatcaagctagtgaagtagagcttcgaacacagaattttttgtcctaccatctttatttagaggggatgcattatgactttattgaatatcagtccggaagtagtcaattaatatattgccttgcaggtaaatgtgaagtacaggtagggaagcagtctttttctttaacaagtggaaacatcttattaattgaaaaagatagcgcgtatgcgatcaagcttagtgacaagaatacagtaattataaaatttaagctgaccagcaatttttcatgggaagagcaaatagaaaacgtaacaattgatactcccactgaggagaaactaagtaccctatttttaaagaatttatctcaggataaagcctttttgttcacgactacctcagtgatgtggagtagccaaaatatcagagagatagtgcaagatgatcttaatcatgcggcatttaatagcacaattggattagagttacttaaagtagtgattttgcgcaatttacgtgagcagaactttaaattgagtgaaagaagagaaaatagctttaaggatgagacactagatcagtatatcgaccaacactataatgacattactctagcagaagcggctaaatattttggttttaatcgaaattacttctctacaatggtaaaagaaaaaactggtaagagttttgtggaacatgttgacgatcggagaatgagagaggctagaagattactcgctaagccaaatgtatcgttaaaagaaataatcgaaactattggttattcaagtaagtcatttttctataaaaaatttaagcattattatggaatgacaccaacagaaatgagaaagagattatttagagaagcgcatattaatttgaaataggtatgtaaaaagggatgcaattgcatcccttttattacatattttttaatctcttaattcgatccgcagtagatgggtgagtatcaaagagtgagcttaacccacgattatgaagtggattttcaatgtagagcccagcacttgatggatctggatctttcattggctcactgttagaaatcttctctaaagctgaaattaggccttgtggattcctagtaagttctactgagcccgcatcagccagatattctcgattacgagacagagccatttgggcaagtcctgcagcaagtggtcctaaaattagggtaaaaacaattgctactaccttaaaaattgcttctaaaggacttgagtctcggtcatcgcggtctgaattgctgccccaccaccaaatgcgagaggcgaagttagaaataaaagaaattactgctgctagtgcaactccaatagttgaaactaagatatcataatttctaatatgagaaatttcatgacctaaaacgccctctaactcacttctatttaatcgttctcgtaagccagttgtaacggcaacataactatgcttaggatctcgtccagtcgcaaaagcattcgggcttggatcattgataataaaaactcttggcatcggaacttgtccagccagagccatatcttcaacaatgtgccaaagttctggatcgtcttcttcatgaatctctcggccgtgattcatgctcatcactaggtttccaggattttgaagaacaataaaaagataaattaaactaccaataagagcaatggcgattccggaaaaaggttcgccattaattaagtatcctaacccaccaccaacaagagctagaataataacgaatataacaagcaaaaatgctgttttacgcttattgcgtgctatttgttgatagagcattaattaacctaaaatttgacttgaggaacggccttttcttcagttggtgtttgaagatagtccattttcttaaagccatgcatcttagctactaagttagatgggaaagttagtaacttctcattaaacatagcaactgttgagttataaagttgacgtgagtaggcaatcttattttcagtattagtaagttcttcttgaagtgctaagaagttttggtttgcttttaagtcaggataattttcagctaaagcaaaaatactcttcaacgaatcagtaatttgattagaaagtttattagcttcttcgtgatcagaagctggaagatttactaattggtttcttaatgaaactactttttctaaagtgccactttcgtgcttagcataacccttaactgtttcaactaagttagggattaagtcattacgacgctttaattgaacatcaatttgactccaggcttcatcagcatgaaccttagccttttgtaagccgttatagatgccaatataaatagctaccaataaaattaaaataatgataataatccaggttaaacccataaactgaatcctttctctatatcataaatattaagctaaaaaggttaggaatattgtaccaaataacagaaaattaagacataaaaaaagcacagttttgtgcttttttagatatctaaataacaaagtctaggacgatccatccaaggattgtcaaaataattaaaccgccaaattcgaggactgaaaatatccagaagaatttgcgctttgatactgttccgttttcaacgaaacttttgaaaacaagcatgttagccattgatccaacaagtgaaccaaatcctccaatatttgaacctaagaatagtgcttcagcataattggtaaatttaccaattaagatggttgaaggaacattagaaataaattgacttgaaataattgaagttaagaagacagaatgttcagagaacatagtcttggaaataagcgtaacgataaatggtatctgctggatatcactaataaaaataaagaagcatgtgaaagttaagagcaaagcataatctacatgtaacataattgaaggattaataataagagccaaaattacagcaacaattgctggaacaatattaaaaacaccaaagaagaagaaaattgaaacagcaatagtcaaaaccattggtctgacactaatcctaatatcctctaaaggaactgtaggaataggtttatctttaacaaaaaagatgaataataaaacgataattaaactgaccagcaataatggaagtgaccagctaaaaaatttaagtggtgaaacgttatagcgattaactacaaaaatattgtgaggattaccccatggagtaaaagcggctccaatatttgctcccatcccgattaaagtaacaggtagaatttcaggtaaattgtgacgtttagcaattgttaaatataatggtataagagttaaaacggttatatcattagttaaaaacattgcagatacaattgataagattgtaaaaattgcagttagtcttcttgtacttctagcgctagctgtgagcttataagctaatacatccaaaacgtgtaagtaagaaaaaatttggataatagtcagcatcgctaaaattgagtatagtgtgtggaagttaatatcttcaatccttgggcgggcgaagaataagcttatgatcgttatgacaaccgtaatttgtaaaatacggtctttagcaatatttttgatgacggtcattaatgtcccctcttaaaattaaatcaacactactattttgaactctttagcgtaagttcgcaacgcttttttcagattatactttcctattaatatcattttgagcattttattagggaaagaagagagaaaactgctatatttaagttagtagataacataggaggaatagactatgcttgattcaaaaaatattgaactaaaaataaaagatggtgctagagaagttttagaaaagaagattaaaccgggacaagttgtcttgttagccttaaatgatggctcaaacggctactctaaattaggcggaacttgtacgattggtgctaattttcagcttgttttattagatcataaggatcctgcctttcctattaaagttaaaaataatatggatttagatatgtatgcatctgataaagaattagcatttttagatgatggattagttcttaacgcgcgtaatgctgtcttatccctatcttcaaatgaagggattattgatggcggagtcacaatttctgaatttaagggtgaaaaattatctgcagatgagatgaaaaaattaggtggaaaaatctgctaggtattgaagtgacgtgcttcttcgtggtatgataataaaagattttcgaaaattttatttgagaggaagtatagatctatgcgtaaaggtgaaaactacaacactggtgttacaccaaacttaagacctaagaacaagaagaattctaaggctcgtgttaagagagctgctgaagtagttgctttcttaaacaaagctgctaaagacgaaaacaagtaattaaatttactactcaataaaaggagagacgctgtttagcgtctctccttttttgtatcgaaagttatataaatcgaaattaatataataacattttgttgtatttgaaattatattactatataaattgtcttatagaagacaaagtaataaagcataggatataagttttaaaatgaataacatttcgataaaagggctagaattaaaagcaatttttgcccttattttgccgtctctttttttaggagtagcagataatttttcagataatgttttttggggagttgcgatgcttctggtattaggtgcatttgttggtctaattttgccaaatattgttagtacatggcttattttaattttaacggcattgggaatcagtggcttaacccttggctatgtaagattagatatttatgctaaggccatattattgctctcgtttccaatagaagcctatctagcgagtcagttgagagaatgcatttttaaatggagtatctataagaaaaatgaagctagtgtttatcgctatattacccactacgatcaaaatgtaaaactccaaacgacttataatgcacaaaagctttaccaaaagattaagcagaattttaagagaaaaaagttatttacctttgtgggaatgactttaccatcattaaatgggagcatgaacaacagtttgctcagtttaatttagaagagcatagtcagattttaaaacaaatagctaaggtacttaaaaagagtagattagttgatgaaaatttatattacctgggaaatggtgaatttttaattatttctaataccattgcacctggaactttgatggttttgaatgatgaattaaaagacaagcttagagctttaaaatatgaagactatcatccggcctttaaaatggttactcagcatattgttgagaaagatttgaaactctacccggatcttgatgcaattcttaaacatttaaaacgaaagcttgaaacagatttagtggttgaatatttaaagggagtagaatcatgatagacgttttctttatcttagcgattttagttacattaatatttttaattgcattttttgttatgattcatagtctttggaccatttatcatcaaactgaacatacagtccttcatttaggaaagcatcatcatgttaaataatattttagcattttcaactttagtatctatttggttttctcttttggcatcactagtaacgctttatggtgcaattcgtttttggattagacatagtaaaaaaattgtttatattactcctctaaaacgctaccctacaattacgattgtagtgccggcccataatgaagagcttgtaattgctaaaacaacaaaaggaatccttgatttaaactacccggtttcaaaaatagaagtacttttatatgccgataactgtcaagataagacagctgttgagatgcagaaggcagttgatatgcctgaatataagtatcgaaacgtacaaattattgaaagacagggttctggaggaaaggctggggttttgaatgatgccttagaaatagctcaaggcgaatatatctgtgtctatgatgcagatgcattaccagaacaaaatgccttatattttttggttaaaaaagttttagagaacccaagtcgctacatggctacctttggaagaaataaaacacgcaatgcaaggcaaaattttttaactagatgtatcaatcaagaagtaattgtttctcaacgtattcaacatgttggggtttggaatttatttaaaattggacgaattccaggaacaaatttcatcattaataccgagtatgtaagaagtattggtggttggcaacagggcgctttaactgaagatacagagatttcttttcggattatggaagatggatacttgattgctttggcttataattcagaagcatttgaacaggaacccgagcaattacgtgattattattatcaacgattgcgctgggcaaaaggaaactatcaagttgtgataaataattttaagcatttatttgataggagtaattggcgggttaaattagaaacattttatctaacttgtattttcttttggtttaacttagcagttgttctttccgatattatcttcttcgtagatttaggatgtgtagtgataagatttttcaatcctaagatgccaattatttttgcaatggattctaacctcttactgatgcaacttttattaattaattggttattgatgattcttttatatgtaactcaaatcaatttggccttagctacacagtatggacaagccactagtgatcaaatttggttagcattggggtcgtattttacctattcacaattgtttattgctatttccatccaagcagtttgttcagtgatcggagataaaatttttaagcgcgatgggagtaaatgggtaaaaacaaagagatttgcagattagggatagggcatgagagttaaaaatttaatcttgattttaggtgtgatagtagcttatttaggaattatcggatatgtaaggatgagcaatgatcgcacaatagaaaaaagatattatcaagtttggcgagaagactatataaaaaatcaaagtgaaagtgagcagtatgttaacgcagctggaaaaaataagacaccttttgccttgtctgaagcacagggatatggaatgttactagctgtgaaggctggagaaaagcacttaggaagccaaactgattttcaaaagttggataattattatttaaagcatcaattgtctaattcgaacttaatgagctggagacaagaaaataaaaagggaagtttacaggataatccagtgagcgcaagtgacggcgacatgatgattgcacaagcattgcttgaagccaataaagtttggccagggcatggatataaagcacaagcgcttaaactaattagtgatatcaaaaagttagaaagtaatcgttcggctaaaataattactgtaggaaattgggcaaataaaaaatcacatttttataatgtaatgagaacatctgatgtaatgccacaagcatttgaagaattttatcaagcaactggagatcggagttggttaaaagtaaaatcacagatgctgacttatttacagcagcttagtagccaacataaaacaggactagttcctgattttgcctggatttcaaagcaaaatcaggcgtctcctgctaaggctaatgatgtagcaaccaaagatgatggtaattacagcgctaatgcttgccgagttccgatgcttttagcagcaagtgatgataaagaagcaaataatattgtaaagaaaatgttgagcttctttaagcaaaatgaagaaacatcaagtggatttaccttgagtggaaaaccgttgtatcagtatgaatcggcaagctttagtgcgccgatcttagtagctgcaagtaagtatcaaaatgaaggatatggtactttggtagaacatgaaaaatatattttttcaaaaccgcttcctgttaataattactacgatgcgacactaattgttttagctgctttaaatacaaatgagttgacgggattagagaaatagagaaagattaaggtgttaaatctttctctatttttgatttgcaagagtagagtggttttgctatgatagtagaaattttagacatttttatatttctggaaggggtaagtttttatgggattaaatgcgtacattcaaggttttaatagtttagagtcgatcgaccgtgcaccaggatattttaaatatcaacaccattctgtagctgatcatagctttagaacagcagaacttgctcaaatgatgggagatatcgaagaggtcattggtaagcaaaaagtaaattggaaagctctttatgaaaagagccttaaccatgattatactgagcgttttattggtgatatcaagactccagttaagtatgcaactccgcaattacgtaagatgattggggatgttgaagaaaccatgactgctaaatttattaaggatgaaattccaaaagaatttcaaaaaatttatacaaaacgcctatctgaaggaaaagatgatactttagagggtaagatcttatctatttgtgataagttggatttactttatgaagcttatggtgaaattgaattaggaaatccaaatcctgtgttcatgcagatgtttaaagaaagtcttgaaactattaaaaagtttgatgatttaacttgtgttcaatactttattaagaaaattttgccagatttatttaagggcgattttgccggtaaagataaaatgcaaagaattgcatttagtattttgttaatgggggaagaataggttgaaattacagtgtgcatcctgtggtttacgacttgatagtcttcattttaagcaagaagggttaatgaaccctaagttgacaagtatttgtgatatttgtttaacaagaaatttggatgcagagaactatgaaaatccggtagttgaaagtatttcccaggtgatgctctatagctttgtaggaaagaagaataatggtcagattaagccggattctttaaagcactatcttgtagacaatactaataggcgacagtatgagtcgttcattcaagattatgatggcaatgaagttgctttgcaacaaatttcacgtcgtgagtttaatttagcaattattaagagtgaagataatgaaatagactatgttcctgagaataatgttgattttgcagtaaatatgaaaaagatggggattgaagttgatttttctttaaatgaagttgactttgtagatcgggaacgaattcggcataagtataattaccgctgtcagtattgcggccggcgtggaacgagtgtagatcacaaagatcccgtttctttatcacatgataattcttttgataatttgattttatcgtgtagtgaatgcaataagattaaatcgaacatgccatatcaattatttgttaaattgaacgatcaattaactatcgtaaataaaaagctagttaagtatgaagatgctttagctaatttgaaggaagagtttcaagctgctaaaagagacttggctggcaaggttcatttaaaaggaattgtgaatgatccagaattaaatgcaattcggaagcaaaataaaaaattacaggacgcgattgatagtttgcaaagtgactatggtgccttgcgtaatgaacgcaaaacatactttgatattggttggaaattagaaaaagagcgagaaaatagcgaaattatttaattctaataaatacaaaaggctagtataacactgatagtggaatactagtctttttagatgattaaagtatttttttgagagcttaattagtactgttaagtttgcggtagccgaagtaaaattgaaggcaagctaaaactacgttaagccaatttagccataagaaacaatcagctaatccaccggagtgagcaccagtaccgtagtaaacccaaaaaccaataatcactgctgctacattaatccaggcaaaggatttttgatatgattgtttgtttaatacaaaccacatccaaataacatttataataaaccagattactaaaacccaaaatacaaaatcaaacattatgtattttcctttcttttacgtttaataaagtctcaattagtatattgggaccattcgctcttttcgggaatagtatgaatcctaggaaccatgatttcaataatttgtactttgttaaaagaaaagatactaaaaataaataggtagataacaatagactaataaaaagtctgatagttcaatgtttataacaaagagtatcagcctttttataatttataggggaaaagcaaattctatattattttgcttaaagttcattatttctgaagttacgtaggaacttcttagtcttttcttcttgtggatcgttaaagatctgttgtggtgttccttgttcggtaataactccatcactcatgaagacaacttgatcagatacatcacgagcgaatcccatttcgtgagtaacaatcaccattgttagtccagtcttagctagtaattgcatggtattaagtacttcaccaaccatttctgggtcaagggcactagtaggttcatcaaagagcagaacttctggatccatagaaattgcccgagcaattgctacacgttgttgttgaccaccagataattgttgaggtttagcagtaagaaatggatccattccaactttctgcaagttttcaatagcaacttttttagcttcttctttggagcgaccaagaaccatttcttggccaatcatacagttttgaaggacattcttgttgttaaacaagttgaattgctgaaataccattccgaccttagaacggaaggtattacgattaaaatgaggatcaagaatgttttctccatggaagagaatttttccattacttggttcttcaagaagattaatacatcttagcatcgttgatttaccaccaccagatggaccaataatggtcattacttctcctttattaatattaaaagaaatatcttttaatactgtatgatcaccatatttcttttgtaaatgttgtacttgtaaaatgttttcttcgttattattgttcatgttcaaatccagtctcctttggatcttctacttgtaattgattagccattaagttgtagttctttggaccttcaagcttcttttcaatgaaattaaagattctagtaattgagaatgtcaagattaagtagatcattgaaatgatgaagtaagtttggaagaattcgaaggtttgactggcaacagttgtaccaacaaagaacaattctgaaactgaaataatacttaatactgaagtatccttaatgttaacaataaattcattagtaattgatggtaaagagtttctaattgcttgaggcaaaataatatgccacatttgttgagagtgggtcataccaagagcagaagctgcttcaaattgtcccttaggagttgcattaataccaccgcgaataacttcagctaggtaagcaccggtattaattgaaacaataactaaggcagcgacggtacggtttaagttaaggtgccataattgagcaattccgtagtaaataacagctgcttgaaccatcataggagttccacggaatacttcgatataaactgctaaaagccagttaacaatctttaagccccatcttttaccagtagacttaggagttgggatagttctaacaataccaacaagtaaaccaatgaagaaaccagcaatagtaccaactaaggctaaaagaagagtcattccaacaccgccaaggatcattgaaccatagcgacgcataattgacataaaccaattttccttcttactgccacctgcttgaggttgttccttaacagcttgggccattaattggtcacgctttttattagaaataccttttaagatattgttaacttgatctaataattcagtgttacctttcttaacaccaattgaggtaattgagtcttcgtaaggaatgtggaaaccttgcatcttgttaaggttaacggcaacaatgttagggttaacagtcttgtaactttgatattcaatatcttcagcaacataaccgtcaatagtacctgattgtaaactttgacgcatagcagaaaagcttctcattgcaggttcacgcttagcaccatgtaattgcttgattaaatcgtagtgaagagtaccttgttgagcagttaatttagctcccttaaagtcatttaagccttttgcttgagcaaattttccatctttattggtaattactacgaaagtaccttttctataaggttcagagaaattgatagcctttctacgttcagcagtaggagacataccagcgataattaaatcaatctttccagaagttaaggctggtaataatccatcccattcagttttttctactactactttacgatgaagctttttaccaatgatttttgcaatttggacatcatatccgtttgcatattgcttagatccatcaattggaaccgcaccatttgcatcagttgtttgagtccaattgtatgggggatagttagcttccataccgatttttaggggtgcttcttttttagccgcttcggtttgattagaattaaagctaaaaccgataactaaacttaaaattagggctaataaagcaccaaaccatcttatttttgacttcactttgaaatacctccaaaaattatttcaaataaagccaatacaataaaagcgtaaataaaaagcctcgttgtttgccaaaaacaacgaggcttgaaaatcatcagtaattaaaccaaatcatatagcgctccctggggacgaccaggacagtatgtaagatattctcttacataccaacaaattaacttcacgaaagaaaatttatttcggcggtaatcctaaaatatactctcactgtattcgcgtactcaagtagattctgtgattatcgcaacctctattgcattggggatttatttaactgatgaaaagattaaacgatttttaatcttttgtcaaataaatccatgattttttttgatatcttttttcttaatgtctgaaacataaggattaccgctaacgatgaatcttaatttcttctgagcccattcaggatctgattgattaattcctactcttggaagggcaacaatttcttctatttcgcgtttgtgatcgatatcaatatcaaaaggcgaatcgttcaaatcaaccaaatcccatttacgactagtaatccctaaggcttgcatcatttttccaggtccattagtcaaaagcggtcccgttttaccgctacggtttttaatcatcgtgtcaattcctgttagaggatcgatagctctgattaatactccttgcggttcaccttcttcttgacaagaaacgtcaaagaaaaaatattgcctttgggaataaatatataaactgccacccggccgatataaaccctcatttgcgggactacgtctgccgccataagaatgagcagctcggtcttttacaccgacataggcttctgcttcaacaatagtaccagatagaatttcttctccattattgtaagacaaggttctacctagtaggtctttactgatttcgcttgtagaacgattagtgaaaaattctgtgtaattcatattaatttttctttctaaaaaaagttgtacactgataattgaagataaatattagcagcgagtgaggaatgtaaccatgaatgaaataaaagtagttagaatatatgaccatgagcaaccagctggttatcgaattttggtagatcgtttgtggcctagaggaatgagcaaggtaaaggctcacttagatgaatgggataaagaaattgggccaactaatgaattgagaaaatggtttaatcatgaagacgataaatatcctgaattcaagtctaagtatatagcgcaattgaaagctaatccagcaacaccagcttttattaaaaatgtaaaagaaaaactagtcaaagaaaatgttcttttcttatatggagctaaaaataaaaagtacaaccaagcagttgtacttaaggaatttattgataagcaattaagttaaggcattttcttaccgtgtacattttgtcgtacatagtgaaaaataattgttaaaataaccgtgccaaatacaataccagcaaagattgcatcaggtaatttaaagtttaacggtggcagtgaaataagcagtttaatcgcaataattgagattaagacataggccatagtctgaagctctggaataatttccattagcttaataataatttcggctacgccacgcatgcataaaattccaatcattccaccaactagaactactactgggttatttgacatggctaaggcagctaaaaccgaatcaattgagaaaacaatatccattgactcaattgagattacagttctccaaaataaggaaagatggtgctttctttttttggagttctttttcttatgattctctttttttgcttcttcttttttagcgacttgttcgggatgtcgaacatcataaaagtatttataaactagataaagtaaatataggccacctaataatttgatttcccagaagttaattaagtaagtaccaattccaattacaatgaaacgaaataaataggctccccataaaccataaactagagattttctttgttcatctttagtgggtaatacttgtgtttgagctgctaggacaacggcattatcaacggaaagtaaacattccatcaaaattagggtaagaatcatcatccaatcttgaccgctagttaagacgtgtgcccaattattagcgtcaaaaaaaggttgataaagtttaattagctgcatttaaatagccttcttcgagatttattaaacgttgtttttctttctctcccattctataacttcctaccttatctggagctaaaactacacgatgacttgggatgaaaattaaagatgggtttagagctactgcatgggcaactaatcgaactgaagtagaaccattgatggaagctgctaggtcacgataggaaatagtagtcccatatggaattattttcaatcatttttacaaccttattttgaaatggtgtcccaaaacttgaataatcaattggaacagtaaaagaatggcgcttcccagcaaagtattcttttaattgttgaacataaggagcaagtttttttgagtcttgaatcaaaatatgattaggatagaatcccaaaatggatgcttcaatgttactattctttgatccaacaaatgctaatcccaagttgctgataactagttcatagatccatggtttaatttcaacaaaatcataatagaaaacttttgcttgggcaagtggcatttaatcctaacctttcttttaattgatatattaactgtaccttatattgtacaacaaaaaataacataaggaggagggaaacaaattaaataaaatgttagttaagataatagcggttatatatataatttgtcaaatactttttcagcattctcaataattgttgaaacttctttgggagctggtacaggagtattattaactacccaaatttttgcattagcttgccgataggcgagaagttgagcaaaaggataaacaacaaaacttgttccggcaataataactaaatcgctatcatgaatcttttcaacagattttgtgagtactttttcgttaattggttcaccgtataaaacaattcccggacgaattatcccttgatccttttcatgaaggtatgattttttatagctgtcatatgaaattttttcatgacatttagtacagtagatattataaagatcaccgtgaaattctatgacgtgtttattgccagcttttttatctaaaccatctacattttgagtaattaaagttccatttttattgcaactagtagcaattttttgatgaataatattaggttttgcatctggaaaatacatattttccattacgaagtgatgaaatttagctggttgatgaaaaagagtttcttcacttaaaatttgttctgggctttccgaaatcccattgtaaattccattttttgaacgataatcagggatatgcgacggagttgaaacgcctgcacccgttaagtaggtaatatgatgagctgcattaagatcagcttgaagtgcagcaatttgcttatctacatccataattaaaacctcctactattattaattttcagctaagtcaattatagaatgctgagagaaaaagtggtatttgttataattaaagtaagatttttaacgttaataaatacttttagaaggaaaattatgtcacttttatatatttcttttgatattttgctgattggctatattttttatagctggtattggcaagcaaacattgattataaggcccgctttagaagttcctcagttatctgggctctaatttttttactaatcggtttttatttagattatttcactgatccaacagttcttatgaatgtttttattgctacatttttgctaatgagcataattgatggtgttagtgggctagctaagaagcgtctagttgtaagtggatattttaagcgaacagttaagtatagcgacattgctcacgttacattaattacagttcccaatcctaaaaagccaactgtaatggcaatctttcaaactaataatcgtcaggcttactatcttagattctcacagcaggttagtgatgtgattgttaatatcagaaaacatctcggctcaaatgttggaatagaagtccaatcaatgatgtaaagttaataaaaaagggtagatctctaagtactcatattgcgagtagggaggatctatcctttttattttatagaatgggagaaagtaatctagaaaaagcttgtttaaatcgaagataacgcgaccagttatcggtaatttctaaagtcaattctgtacatttagctaaatctttttcaaaaatatgatttaattcccgggtaatatttttatcgtagaagactgcatcagtctcaaagtttaagctatatgacctaaagtcttgattcattgatccagctgcagcgaagcgatcatcaaccatgacggtttttgcatgaataaaaccattatcataaacatagatctttattccctcatggagcaggtaatttgcataccactgtgtagcgcggtaaataaagggatgatcaggcattgaaggaatcatgatacgcacgtcaacgcctgaatgagccgcaataacccaagtggcaatcattggatcgtctggaacaagatagggtgtttgaatccagagtgtttttctagccatcatcatcattctaatcatgccattacgtaaatatggcgtagaagtatcaggaccatctgaaacaatttgagttgcaacatcatcttctgttagctgattttcttcaatttttggaaatagtttttcattaaatgaaattgtctgatttttatcagtaattgaagcattccaatccattacaaaacgctcctgcaacagcagggacgcggagccgacgattctaagatgagtatcacgccagtagccaaattttttgcttttgctgacatattggtctccgacattaaagccgcccgtccaagatattcgcccgtctataacgacaattttacggtgaaggtgataattcatccgatactttttaatcatgttttgagctgtgataaaggctacaacttcaccgcccaaatcagttaaaggtttaaaccaagtctttgaagctccaggagaaccccaaggatcatagataagtcttaccttaacaccttcgcgagcttttttaattaataaattaagaaatttattacctaaatcatcattcatgaaggaataatattcaacattaactgtttcttgagcttgttcgatgtctttaaaaagagcttcaaacttcttttcgccatcagtataaaaactgattttgttgtttttagaaaggggggaatcgtgcttaaagttaaagtaatcaattaaaattttggcttctttagaagtatctgttggcccagcggatttaggaacacgcgggatcatcttatttactttatttaaaccaatgtgtttttgattgttaatggcaaaaagattttcttgtgataatccacgtccaataaaaccatataaaataaagcctaaaattggaaaaattagtaaaataattaaccatgcccaagaggtagcgacagatctttttcggtggaatacaacatagaaggctaagattgtgttgacagcccaaagaagtgcccaaaattcattcgaaaaaataagtatccctcccaactaattaattattatcgttgttatggcctccaaaaatgagtagaagtctaaacaattgtaacatgcttgttaaaacggctgcgacatatgttaaagctgctgcaaataagactttacgggccattggcatttcttgtggggataaaatagccccattatttagcatccgcaaagcacgatgagaagcattaaattcaaccggtaatgttactacttggaaaagcagaactaaggcaaagcaccaaatgccaattctaattagggtttggttcattcctaacactaatcctaaaagaattagtggcattgataaattggaaccaagagaaacaattggcactaaggcagaacgcattctcattggggcataatcactagcatcttgcaaggcatgcccaacttcgtgcgctgcaacgccaaccgccgcaattgaagaggaattatagactgattgtgaaagacttagaactttattggtgggattgtagttatcagtcaaattgccggcaacttcacgaatttctacttcgtatagaccagcttgatcaagaatataacgggcagcggctttaccagtatagtttccttgatttcgaacttgatcataacgattaaaagttgaattaacattcattgaggcccagcctgaaattgctacacctagaataatcatccaaaaatatgggtcataaaaaaatggcatatagtacataattattttctctctttataaaattaatcacttaacttcaaaaatttgttaataatattaattacaaaaggattatcgtgtaaaacactgtgctcagcggcatctccccgcacctctacttcttggaaggtgtgagcaacaggagcaagaatgtagcggatcgatttagcagaaacaacagaaataaaccgatccgtattagtttcatctaaaatatttccataaatatttaaaactgaaatattggggttaaaacgtctctgattaaaaagcattcccatataagagggactcattaaaatgggtcgccctttttcattaaggcgattgacgttaggtaaatcacctaaatacattactccatcaaaaggtccagcaatcaaagcacagtgatctagatgaggaaaattctttcttaagctggttttcatctccgctttgattactgaaggagctcctaaggaatgggcgacagcactgtattttttgaaatgatatcttttacttaaataagaaagagctgctcgaagataataagaactagcataaacaccagcaattcgatccttaaaaataagttgcacaatgggctgcttatctgctgtccaagttccttctaagatgaaattaccaaatggatcaattgtagctttaagaaacttatcagtcccttttgcctcacaggcagcttggaccattttatttgttgtataatctcctccgcgaaaaccatgcacataaaatacaggtatctgttccatcgttggatctatttcttcagtaatcgagctatcttcaacttttcttttgtgcattcgtaggagccagcgagtaggagtaaaagtagccattaaacctaaaacagtcattcgagcaatgctaggttctttgttttgatgcttattgtttttttcaacttcttcactatattttttctggataaaaaacactctttttcctcccttctttctttgtaattttagcgttaaaattattctaacattttctaggttagagcaaatgaagaaaggaacaattatgaaatactacgcagtaaaaaatggccgcacaccaggtgtttatcgaacatgggaagatgctaaaaagcaagtagatggattctctggtgcagagtataaatcttttgaaaaaatcactgatgcaactgaatatctagattggaataaggaaacacaacctgatattgttaaagaagattctttaagtaatgcaattaaaaaaattaagtcagctagtggagcatctcaagctaactctaagacttcggctgactattttgccactatttacactgatggaggatctcgaaatactggtgttcataaaggcggtcatgttaatgagaccgataaagcagcttgggcttatttaattgaatgggataatggacgtacatatggttctgggggagaatttggtgccacgaataataaaatggagctactcggactaatcaatgcactggaaaaattaattgagctaaaattcaatgacaagcacttattgtttgttttagattcacaatatgttttaaacggaatcaataaacactggattgagggctggaagaagcgtggctggaagagatcaaatgggcctttgattaatgcttctgaatggaagaaactagatagtttattgggacacttttctgacagtgaatttagctggaccaagggacatgctgacaatcaaggaaataatttcgttgatcacgagttaaacaaatatatggatcaaatgaaatagaaagttcaaaaattcgtaatatcactaagagagactataattagaagtgaaagcgcataaaccaatttaaatgaggtgatattatgaaaaagttctttaaagtagttggtattggtgcagctatttgtactggcattggtgcggcagctgctgtaaccaagaagcttatagataaaaacaataatagtggcgaagatgtagttaaagacgaagaaccagagtttgaagatggagaatctgatgatagtactgaaaattcgactgagactactgattcaactgaaacaaactaattattaaaaaatccgcttgctaaataaaaaagtctgcaaaattgcagacttttttgatgcactttttttagtagttgctataataataagtgaaagactagaacgcacgcaggtactagttttgacgacggagacgactacaaagtagccgtcttttttcttagattttagtttaagataattgcaccgccaaagatacctctgaaccaactaacgatagaatcgattagtttttggaaccaatttctagtttctggagtattaaacttagaaaaaatatttttagctcctgattgaatttgatcagttaattgactagcttgttgttggaaattcttgtcttttaaggcaccagaatttttaactttgattagaacattgataatttgttctttttggttgttagtaatagtgtcgccaaggtggttaatgttgatttgattattaacaatatctctaacttggctgtcagaaatattttgaccttgcttagccatttcttttttagcaccagcaactgcattatttaattgagcatcagagtagccatctttacctttattttggctagtaattttgctcaaagtgttcatttcagtttgtgccgcattaatttgcttttggttcaaagaatccccatttttagcgtaagctgcataaaccccggctaaagcacctgatccatcaattggagtagcagaagttacataaatatctgcatcagatattccggcagttagggctgcatttttatattggttagccgtaatagttgtaatgttattatgaccgttataaggtaaaatatgaacattaataccactaccggagctagttttttgaaccatggcactagaccaaacgccggagttatcagtaaagtcataaccagacggattaagatattttacaagatcagatccagtaatggtaatggtagtataattagcgccatttaacgattgggttaaggtatcaatcgtgccttgtttttgagaggcagtcagggatgtacctaatgttacaacaggagtgtcattatcatcggctttagccgttttagtattagtaatggcacttagccctaagattccacttgataagatagcaacaagtgtagtcagtatttttttcataataaaattttctccttatgaaatatactcatttgatggctatattataacctaaatagttaactgaattatgtaaataagtattaagatgctataatcataagcaaaaggaggcagacgccgtgttacgccagccaatgttaacggtaattatgcccgtctacaatatggaaaagtatttaggtcgggcacttgacgctttagctaaacaaaaagatagaaattttaaattactaattgttaacgacggatcaaaggatagaactcgtgaaatagccgagtcataccgggatcggtttctttattttgatattattaataagaaaaatggagggctttctgacgctagaaatgttggaatgactcacgtaactacaccatattttacttttcatgatggggatgattgggtagattcaggctatactgcctactttgtcagagcctttgatgagcatccagatgttgatattgtttcttgtggtttttggattgattctgaaaagcgccatgaaagtcatcctgtcggaagtaagcaaagtggtggcttaattgataaaagagaagcctatttaaagatgaccaatgtatttggttcacccgttaagggttatacctggaataagggatacaaaattagcatcattaaaaagtatcacttgcggtttgtagaagatctggcatttatggaagatcagattttcaatgttaaatatgtatctttgactaatggcttttactacagctcaacaccttattatcattactggcagcgagcagatagcatggtgcacgaccttaatccaaagaaaataccagataattttagagcaaattatcgggtttggcgccaaattattaaaagtttgatggcagagcgtgagactcaaaaggaaagtaaaaaaatcgccaaaaaagcatctttaagtgattttgaccatcaagatttataagaacttacaactaaaggaatcaatatgaaagtaaaagttaatggggtaaagatttactatcaaaaattaggtaaaggacatcccttaattttattgcatggacatcatcaagacggtgggatctttgataagctagttgcgcccctttctttatactatactgtggtagttcctgacatgcgtggtcatggactaagtgaaggagaggccagtgagcactatcaaacagaagtagaagacttacggacctttattaacgcacttaagttagataaaccatatatcttaggttttggctctggtggcttggtagccctttctttagctgcgcaagctccagaattagtttctaaagtaatagttgcaggtacttatgttaatggaaatggtgtgaacgcaaaacatattgctgctaatacaattcgtggattttttaaaggggatcgcgatagtaaggtggccttaagagaaagtcatatccctgttgaaacgctaaagcgaataaaaactcctactctatgtgtagttggagaaagagattgggttaaagttgaacatgttcgctggtatagtcaattattacctaattgtcgcttagtcttaatgccgcgtcaaactcactacagttatgttgttcatagcttaaaattattagatttaattaaagatttttgtaaagaggactaatttactagtcctctttttctttttgtacttaaatcagatagaattaatatataaagtataaattaacgaggcagaggataaggattatgaaagaaatagtagtgcagggaatgaatggagaaatggtagtagagggagataagattactgtgaagcatacaggacctttatttttaggtaagcgtgaagtagtgttagatattcatagtctgcaagcagtagtttataaaaaagcacatctattaattaacggctttctaaaattagtacctaagggagataatcccatgctttatcaaactgccaccttacatcaaatggggaaagacgagctagccattattttacgtgcttttgaaaatacaaacccacaagatgcagaagatttttatacttatgttgttggtcgtttagatcaaattaaggcatctgaaaataatcatttataatctacagctgaaaagtagagcaaaataggaatttttcgttataataagaatagctgttaattttacaaggaagggcaaattaatgaaaaaagaagaattgcacgaaatgttgcacccaatgaaattaatcggacttggtggaaaccaagctctagcagaaagaattgcggctgctttggataagccattacttgaaactgctgttcaacactttagtgatggagaaattcaagtaaacattacagaaagtgttagaggttgtgatgtctacgtaattcaatctattcaagatcctgtgaatgaaaacttcatggaattaatgattgtattggatgctttacatcgtgcatctgctcactctgttaacgtagtaattccttatatggcatattctcgtcaagatactaagaatcgttcacgtgaaccaattactgcaaaattattggctaacttgcttcaattgactgatattgatgatttaattgcagttgatttacatgcatctcaaattcaaggtttctacaatatcccagttgatcacttacatgcgatgccaattttagctcaatacttcttagacaatggtattgcaagtaaggaaaatgatgatgtagtagttgtttctcctgatcactctggtgcaaaacttgtacgtacttttggttcatacttcgatgctccaattgctattgttgaccaacgcggtgcacgttatgacgcagaagctcatgatatgattggggatgttaaagacaagacagtcattatcgttgatgacttgattgatactggttctagaattgcttcttcaactagatcagtcttagctgccggtgctaagaaagtttatgttgctgcaactcacgcactactttctcaaaatgcgatcgatgtattgaacgaattgccagtagaacaaatcgtagtaactgatactattaagcataagaagtacccagatagaatggttcgtttatctgtagcacgtttacttgctaaaggtattgattatatttacaacgataagtcaattcaccaaatttttgatgaacaaaacagaattcaaggataattcacattaaaatttaatatttaagaaaagactgatcttggtttaaagtttagatcagtctttttgtgtttgaatattttatatttaattaagagtaaaatctaattaaatctatccttaaaattatgcctagccttccagacacaatttgacaattttctcatgcaagttataatacaaacaaataaaatagccaattaattgactatacaagaattttaatttcataaaaagaaatgtctctagtatatgttaaatactagaggcatttttgtctttaagggaggactataaaattggatgaaaaggagaagctaaagttaaaaagatcacttaagagtcgtcatgtaacaatgattgcaattggtggagccatcggtactggattatttttagggtctggtacagctattcaaagtgctggtccatcaattatcttatcttatttgatcgttggtattattagcttttttatgatgagggccttaggagaattaattttagcggatcctgagcaacactcatttattgaatcagtgaaaaaatatcttggaaatagaatggaatttgttgcaggctggacttactggctatgctggcttagtttagctatggctgacttaactgcaacgggaatttatttgaaatattggtttaaaaatctgcctcaatgggtcggaccattagtgattgtcattttgttaatgctagttaacatggttaatgtgggcctatttggagagcttgagagttggttttcaatgattaaagttttagctatcttagctttgatcattacgggactaattcttttaattatgcatactaaaatcgattctagaactgtttcactaagtaacttggtaaactatggtggctttttcccaacaggatcctggggctttctgaagtcatttcagatggtagtttttgcatttgtaggaattgaaattgtgggactgacagctggtgaaacagctaatcctgacaaagatattcccaaggcaataaatactttgccagttagaattggattgttttatgttggctcgatgattgctattatggcagtttatccatggaataagattgttactacaaccagtccttttgtacaagtttttggagcaattggtattccagcagctgccggaattttaaactttgttgttttaacagcagcaatgtcagcgacaaatagtgcaattttttcaactagtagatccttatatgctttatctcgaggcaataatgcacctaagagattcggcaagttaagtaaaaaggctgttccgaataatgccttaacattttcatctttgattctattcattgtagtaattcttaactatattatgccggctcaagtttttgatattatttctagtgtttcaacaattaactttattatggtttggataattattatgtggactcacttgaagtatcgagcagaaaataaggaacaacttggcaagtttagaatgcctggttttccaataacgagctggattacaataattttttatttagtaattttagtaatattagctttaattccagcaactagactaccattaattatttcaattatttttattttagctttagccttaagctatactcttttagagagaagaaaaagtaaatagtgagaagaaactgacggacaaagcgtcagttttttatataggattaattaaaaaaataaatcctaattcgttattagtaatagcacttggtataataattgtaattaacactatgaaaacgctatactgtataggaatagaataaatagtacgaggaaaaagatatggcaagacaaaaaaatttagtaagacggcatgaaatattacgcaatacttttatccttctgaaaaagagagggatggagaatgtatcgctgcaaatgattgcagataagtcggggatttctaaatcattgctccaatcttactacccacataaaaatttgttaattacagaaattgttaccaactttatgacggctgtgttaaagagtttaaatgcgactgactttaaagaattaaatacatattccaaaatgaaaatttttatttatttaattttagaacaaggtattcaagatgaaggagtagagcgtgtagttaaaagcattttaagtgatagtgattccttagatcgctggagtcaaattcttgacgattggcttagaaatgaaggagttaagcatgatcttggaagtgaccgtcaggttcagattggcttaaactttattgtcacagctggcggaagtttatacataaaacgtgctgaattggatttagatgcagatgaaatttctgatataatggtaaaaacttttatgtcaacatttctatcaatggatgagtctaagatagatcaaacaattgatgaggcaaaatctgctttacaaaaatatgaactagctactttgacccaaacaatcaatgagatgtttgacaattaatttttaaggaaggtctaggaaatggcagtacgcacacgcagtgagttacgtagaattgatcaagctcaaactgtgcatgataaaagatcctttggaattgcaatctttacaattgtggtcttattttttggcttagtaacttttatgaatccaatttttatgaagagtcaaaattgcaaaggaaagcaacggagtagtagctgaacgatatattaatcagaagtttgataatttcgctgcggcaattggtgctgatagaagtagtaataatagcactaataatcttcttaccgttgaacaaacaagaccaattgcagatgcgatgattgattataccttgggcatccatctatttagagctgaaaattcaagtttagctggtcaaattagaaaaattatattaacaaaaatagatgataattcttctatggaagccaaatcagtacaagaaaagctcagaaagaataaaaatagcagtctgtatgcaattataacgagttttggtttagcaaatactacattaatggcaaatatcgagatagtattattagttttgagtattttgataattatttttgtaggtatctttgcttatcagcaaattaaaagattgcaagaaattgtttcaactcgacgtttaattcatatggttgctgctggagggatgagagcagcaatttgcatgattgtgatctttggattactagcatttattccaacaatttttgatgttgaaggctttattttaaatattggttattttttagaaatagctagtggtattttcttggaattagtaattgttggtgtagttttatttgtaattagtactattacttggcaaattactagtgccaaataaaaatttaaaataaagatgcaaaaaaggtctcaggttttaacctgagacctttttctaagaaatggcgccggattggatgatcttaattgtattcaagtaagtgtaaagtagttagggtataaaataattgtaatttgcaacagccataatggctcttgtaagggtcctcaaccatttctcagtacttatttttacagtaattaagctttaaatcaagttgaaactattaattattcttaaataatataattagttactttataggctcttttagagtgttattttattaattaaattgcctaatccattgctttttaccaagataataccaagttgtatggttggttgtaatagattgaccgtaagcatagctttttctaggggtaacgtgattagaagttgttttttgtaaactaggataagggctagtgtaaatatgagtatcaagagaagcattatcaatatttactacgccagcagttagatctggattactgtaaacatagaaattatggaaccattgatcttcacctaaattgtagtaagagtaaccgtcttgataagaacgaccaaaaattatcgggttcatgcgacgatttttatttaaagaatcacgtaactcttctgcttgaagtaaaagagcagatttaatggttgtatttgaagaaggatcatcagcttgttttaagatattgcgggttgtttcatcagtagcctctttaatattttgagaggatgagatagtagatgaatttttaaccttgtttttagtcttagtgctatcttccgaaacttctaattttggttgattggctgctacttgattaaaaagcttaaagctgtactgatagacattagaaatatttacgttatattcatgtcctgagactaacttaatatctccaggaaaataggtcagaatagtgtcgaaataaccgtatcctttgttactaaagttattaacttttgttgcttgacttgtttgaccggtatcaagatcagtaattgtaattttgggagtaccagaaatagttttgtccgataaatagagggaccaggcgatattatttccctgaagtaattcgattggaaaaacgccactatttggataagcaactgtactttttgcagctgctttgtagccatcacttggataggcaacttgttgaacagaatagcgataattattttcaccataagcggcgccaatacctgtagttgtaagtcgactagataaaagccatgcgcggtgtcccgtgtctgaaccatcaagattataggtatcagttaataaatctgtgattacgtccccagcggattgattacttacgttaaagttaaggtttgaacttgcagagacgtttttggcaattgtccagtacgtctcattaatataatcaggtttagtttcactagggaggccatgttggttagtgaatgggttagctttgattgcagccataacgcttgccgtgatttgagcgttatcattatcggttttatttgttgaaatacttggtaagtcaaataaagctcggtaaaaattaatataatctaattgagaattgatataagaatttgtaacagaaccgggtgaaaagggagccgtgagatgaggagtgctggcataaagattatctgcattaaaattttctttaggtaaatttttatattgattttgaatttgatgaacttcttgaatttcatctttagtaaaggttgcagcctgtgcgttagtaactataacggtagaagtagttgtacttaacacaatagttgctaaaaaagtggctgcttttttggtaaaagtcataattactccttttagcgaatcatatagtagcatgatagtaatatatataacgtaattataaaaaaattgcattctttttagactttttttcgaaattgatgcattatagcgtcacgattgtttataataaggtttcgaggacaaaaaggagataaaaatatgactgacaaaattaaggtaggtttgatcttcggtggaaattcttcagaatatgaagtttctatcatgtctgcccacaacatttatgaagaaattgatactaataaatttgatgtttatccaatgtggattactaacgatggatacttagctgatgatgcagattctcgcaaagtattagataatcctaaaatggaagtagctaatcctcataaagtagctaatatttctaacattattgaattaaaagatcgtcctgaaattgacgtatttttcccaattgtacacggaaacttaggtgaagatggttgtttacaaggactatttagagttttagataagccatttgttggagacgatgttttagcagcagctgtaacgatggataaggaaatgactaagatcctcgctcaacgtgctggtgttcctgtagcaaaatggattgcagttaagcgttttgaatataacgatccagataacgagaagttagactatgaatacgtagctagccaattgggatcagatttatttgttaagccatcaaaccaaggctcttcagttggtgtaagtcatgttactaacgaaaaagaatataaggttgctttagctgaagcctttaaatacgatgataaggttttagttgaagaaactgttcatggtactgaagtagaaactgctgttttaggcaatgataaaccaatcgttgctggtgttggtcaaattattaacgcaaaagattcgttctatacctatgaaaataagtatgatgatgactcaacatcaactttagaaattcctgctaagcttcctgagggaattgttgaaacagttagaaagaatgccttaaaggtgttccaagcaactgaatgtagcggcttggctcgtatcgattcgatgcttcgtagtgaagataatgaagttgttctaacagaagtaaatgctcttcctggtttcactaatattagtatgtatcctaagttatttgaagaaattggaattccatacactgacttaattactaaattaattgattacgcaatggaacgctacgatcataagaagactttgttacataaacatgattaaacttagtttaagtaaagggagaatttaggatggcaagcgaccataattttgaagaacttgagtccccagcaaaaacggcagaagaacttcatattagcgtagcaacattaagaaagtattctttaatcgtggaaaaggttactggaaataaagattactatgaaagaaccaagcaaaagtctcgcttgtactcggcaaaggatattgaagatttaaaagcttttagagcattgtctaaaaatgcggatttaaccttgcaagaagcagctagacaaatctttgcagtaagcgataagaaaactgaagaagttaaaaaagcagcaaaaatgcaaaaatcagttgttactaatactgccactgttgatgctgatcaagtagtaaaacttttaacaatgctacaaaatactattgcaagtcagaataaagcaattgaagatttgcagaagcaggtagcgcgtgttgaagctcaaaataaaaaattaattgatcgttcacaccaattagctgagccggaatcagaagattctaaagaaaaagctaataataaagatcaggaagctgccaaagagattactgaagaacaaaaaagtgagcaagaggctcatgaagaaattttaagaaaagctagagagaacgaagaaaagcgtcgtaagcaacaggtagaagaaaatattcatcgtaccctagctcaaatgcaaattcgtcctaagaaaaaacaccattggtgggatcgctttttcaagtaaaataggatgccgaaatgcggcatcctatttttttattcatcatcagattcaataattaatgattcagctagtaatacgtcgttatacagacttaagatatacgttctatatttactctctttttgtccaatcatttctaaatattcacgctcaatagcaaatgctctaaaaaatgctaaacgctgtaaatactgttctgatttagttagattaggctgatcaattgtttttagcaacacacgcatgtattctcgtgttttaacaactcttttttgattgagtaaagtatagataacatggcgcttaactcttttaggtaggtacattttatggactgaaattagagctcgtttaaccatttcattacggatcttctccataacaatgtgtgcttcttcatcactaacttcatggggaagaataaattgaaatacaatcgtgggtacaagcatgctcaaaataattaaaactgcttcagacataataactagattgtagtttttagttcctaaaaagttagcactaattgttaaggctagagcaagagtaacagcaccatgaatacctccaagtgaaaatacagtactttctcgtcgatcatagcgaataactaaacgtccatagacataacgaacaagtaaatttgcgagataaacaatgaagccaacaagaatccacttggctaagtcaccattaaataatttatttcgggatattctgaccatcattagtcccaaaatgataaaaaccatactgttgaaaatatctgaaataagattttgcaagtctcgtcccatatggatttgtcttgaattaagaagtaaactttgctgagattctgcattatgtaataagccagcaaccacaacggcaataattcccgaaacatgtaaatcttctgctaacgcataaagtgctagcggggtaaggatataaattaaattctgtgcatttaaagaattaaatcgtgatctgatgagactttgacgaaaaataatgattatccaagcgactgcaaaacccaatactgctccacctaatgaagaaacaaagaagtcatgaatggtttgcccataattgatgtaaccattggcaaaccatagcaagctcatattcagtaaaatgattcccgaagcatcattaaaaagtgactcagcttttagggaggaagttacccgtctaggcattcgtaaaccattagttacggcttcacttgccgttgcgtccgttggagtactgatactaccaatgataaaggctagtggaagactaatgctagtgaataaataaatactgaatccactgattattaaggccagaagaaccataattacagttaatccgatgatttccttaattcttctaccaatattatgaattctagttttttgaccttcaaaaaacaaaagtggagctacgatcaattccataaaaatttctgaatcaaagctagcaacttggctatttaagaaggggataagcccaataattatcccaacgagcatgcttacatagttaacagataccttgtcaactgcttgagcaataataatactgattgccgctgcaattgctagggtaaaagttgaaatcataagttccattaaatctacctcagataaattactattttttaataattagtaaaaacttttaatgctactatagtagcatactaaccattgaattatttagggaaggcgaaaaagtgaagaagaatgcgaaaatttggcttagtttagtagtcttatttgtgggaatattttttactctaattacctatttttcaactgcttttgcaagtaagccaattgcggtcattactgatagtcaaataaaagatacactagttgataagacaaaagacaactatgaaaacaaagacgaggtacgtcaacaaaatttacatttaaaaattttatccggaaaatataaggggaagacattcttagttactaacacatattcgccgtcccaagcggtttcacaaaagtatcgaccacatcagcgtgtaattgtttcatttattaaaggtaaacctaaattagttgaaccaaaacgtgactgggttgttgttttaagtatgtttttgactattagtgtaattgttttaattacaggaaaacaggctagcttacttttaatttcaatgattttaaatagtatcattttttattttgtaattaagagtgatgtaaaggaaaatggaacaagaattttcttgatttatagtatcgcagcaattctgtttacttttgtatctctagtaatagtacaaggctttaatcaaaagatgctggtgactttaactgctactttgttaggagtttttgtttcttttggtatctttttatttagttatgagagtaactcatgagcgtggaattgattatgaggcagttgactatgctactcaagatcctcgagctttatttttatctcaaacaattctaggagttcttggcgcagtcatggatgaagcaactgatattgtttctagtctttatgcacttgcaaaacataaggccgacttaacatttaaagaactatttattagcggacgaactttagggcaagaaattatggggccactaataaatgtattggttttaatttttatggctgaagccctacctatgacaattttgtatctaagagataataatactttagtctatacctttaaatataccctttctttaggggtcatccagagtttaagctcggcgatcggaattgtactgacagtgatttttgcaactctatgtagtgctctctttttaagaaataaaaaagcagaggtggtagaaaaatgacaactttaactgctcttttattaattcttttgatattgatgattatagttggaggaaaaactggctttaagagttatctaagcgtcgttatcaatgcctgtttactgattttagttgcactgcttatttcttggggagtaaatattgtattagtcggagcaatatttattcctttgaaattactgacgattatttatttaggaacacatgattatactgtagccaaaaatgcctttttaactgccttatgtgtaagtgtaattgtaatgctgataattatcttgtttgaaaatttagcgcaaactcaaggctttggagaccaggcaggggaagaattaattggtttatcattaaatgtaggaattagtttttctcaaatcgcaattttagttgcaatcttttcaatgctaggtgcaattgcggaagccagtgttgcaatgagtgctggtttacttgagttaaagcggcatgaccctaacattactcaaaagcaattaatcgaaagcggaaatgaagttggtgcggatgtattagggaccgccatgaatacaatcttatttggtttatttggtagttttctcccaatatttatttggtatatgagactaaattattccttatttgaaattttaaatgataaactttttgtggatgagtttttaattattgtatattcgttcattggcgtgcttttaacggtaccattaactacaatattcttagcacatactttaacgaataaagaaaataaaaagtagagataaatagaggcacagtaagatgaaaatagataatttaacgttaacaaattttaatgggcgtgaatttaacattacttattatagtttgcaagataatccgcaacttctcctaaagaaaagaccactaatgttagtctttccaggtggtagttttgatcatttatcattaagagaaggagaaccagttgccctagcttatgcagctcatggatttgatgcagcaatagtgtcatataatttaactaccgatcctggcagaatttatcctgacgctgctttatctggtttaactgctgttgcatactttagagaaaacagtgagaagttaggtcttgctaaggataaaattacgacaattggtttttcagctggcggccatgttgttagttcgatgaatgtaatggcagaaagtcaaaagtggcagtctgaatatcattttgagcatgataaagtatcaccaaatgcgactattttaggttatccgttaattaatattaaagatattggttttcccttaccacctgatgctaaggaaaaaatgccaagtgcaaaagatttacttgatacagctgtcggggttactccccaaactcctcctacttttatttttcaggcagtagatgatccggttgtattaattgataatacgattgaatatattactgcattaagaaaaaatagggttcgctttgaggcccatttgtttaataagggtggacatggtttttctcttgctactcctgagttagctactaaagaacgtaaagctgatgcgcatcttgctcattggtttgaattgagccttgaatggttgaaagatagaagaatttacgtttagtttcacgtgaaacaaaaacatatatagaaaaagtccgaaaagatgacatgactatacattttcttttcggactttttaattttattcttttgccataaagaatagaacttcttttccagaggctaaattatcggaagttgccaaaattctaagtttaattgatttagcaactacatctcttaagccaattaccttgtttttagcatcatttggccaattaatttctttactaaagtcgctgaagttttctccgtctttggaaatagcaacttgaacacgtaaaacatgaccgatgcgatcacgtgaacgaggaacataaaccatgcggctgagtttataaatatggttgaaattaaaagttaagtctaaaggactatctttagtgatttgatctttagaaagccactcactagctaatttaagatcagttagattttcgactggtaaatcctcttcgctttctcccgtactagaaactgtaacatttgaaatggcataatccatctgatcacgctttgtatgggtgccaaagtattctgaccaatcagatactttattaccgaacttatttctaattctgaagcggtagcgtgtattaggttcaagctcatggaaagtaaaagtattaccgtcaatattagtatgaacaattccgttaacttcgatatcggccattatatttttatctgcgaaattagttggattagtccaggtaatagtaatgctctttgaagttgagcggtcagttaaaattgctgcacttcttggagaagccattgctgagtcaataatagcatgttgttctacttcgctaccataactaaagttttcaatcatcagttcgaacttattatcatgaatatcaacagcaggcatcttcactctaagagctggttgcagttgaccagtaaagtaaccaaattctttgcatggcatatagtcttgttggtagaagataccttcttcagctttgttaaagctatcaagatcgttatattcagttagtggaacaaattgatcgtttagtttaagagaaactttaccaggataacgatcagacataatagttaaattagtaatttgtttctcttcaagaccagtgtagctgccttcagttgggtagactgtaatatgaagatttgatccgctaacagagctagtgatttgtgtggtagctgcatgacccttttcataatcattagtttgattgtcatcttcatataaaatagctgagcttttactttgtgggtaaacaagggcacttcttaatgactcttgtaaaattgcaccgccgcgtacatatacaggaagatgccagagtgggtaatgcaacttatcgtaaattcgaccaccaattagttttttaccagtgaagaggtcaatccacattgttcgatgatcaggtaagtagaggttatcctttagggaagcgccacttggatcttctcgcccgttagtgattggagcgattagtaggttatttcctagcataaattcatgtttaacttggttagtatagttaactcgttcatgagggaaagctaagaagagtggtctaacaattggcattccatcttgggccgcgcgcgtaagagtatagagatatggagtgattttttctctaagtttaagataggcgcgagtaattctagtcatttttgcattaaatgcaaatggtgttttttggatattaccataattatcaattgaataaagaagtggagtaaagactttccattgtaagtcacggatatttacttgtgcattaccgccgccttcttttccatcaatagcacttcctacatttggctgcccagaaagagacatacttaaaaagctagcaatttcagtagcaatttgttcccattcaccaccaacaccttcatttgcagtagtagccaaagtttgaatagcactccagccattacttgccattgcccaaggacgattggtttgatttttatcaattagaggttcactagcgatagcaaagtcctgcattattttttcattaggaaaattagcaggatcagtcttgaactttaaaaaattagctggtgcatcagtaggcaaggatccatagaatcctatttttacattttgatcttttgcaaaatcaactaaattattcatttcatcttcgtttaagtcttgtttgctttcatagttaggaacaaaccaactaagtggaagatgatatgaattgtacctttcaatcattgcccgagcagaaaattggtactgttcttctccattaagagaggacttggccacaatatcatcattgctatgcgcaattttataagtattgccgtcttcaaatttaattgcactattttcttgaggtttagctgctgtccaacaagtatcaaggtagttaccaagataacccagaccgagtgcatattttggcaagaaaagaggagaccccgtaattttatagtactgacgcaatatttccgctggagaatctcctaaaagatagaaattatcaaaaataggagtttgatgggtaataactgctgtagtcccgtcatcactcttaaagttgtagataccatctttccatgtgtttctcaactctgcaaaaccagcatttgaccagaaaaatccttctggacaagcaacagcaccgggaccagttaaattagtatttttaatctcgataatttttcctttgtggctgaagcttccattttgcatcccgccaccgtagtagaattcgtttttgttctgacgtaagaattcgctagaataatcgctccccagttcaattggactactttgcatcatgcggtagcgatgtagttgatcatcgaaaatactgaagatagctggattcttttgtaagcgaagtgaaaactgaccgcttttaatggtgaaagtctcatcggttactaaaagctgagaatcttcaaatggacgcaaactaaagttacttgctgcgatagttaatgatggagttaaaggcttaaattctgctgctggatcaacgattaaacgaaagatacctttagcaataatgtatagacgcgctcttgttccatctgcaaattgcaaatcatagtagcgagtacccttagccacgtggactaaacgacttaaatgttgaggttgttgtttgttagtaatttcagacataattagttttcttctttaaattaaatttttcatttatgtatagttcatattataacgaaaaaatgagtttcgtgtttttttagatttgacataaagcgctttctggaatattctgtagaaggtggtactaaccagttaaagattggatggggttagaagatgaaaaaaccactttatcagcaagttatttcagatctcgaaaagaaaattaagactgaaatgaagccaaatgatcgattaccgagtgaacgacaacttttgaaagaatatggtgttagtcgaaatacgattcgattagcattaaatgatttagaagaacgtggcattatttatcgattgcatggaaaaggtacatttgtttcgacaatttatctagatcaaactaacttgggaagtatgtattcttttagtgagcaaatgtctgaagcaggccacaagccaacaacacaaaaccgcacattagaacttgtgacacctgaagaagacgttgcaaatcagcttaatttaaaagctggtgagaaagcatacaaattagttaggttacgtctagctgatggagtaccactaatgtatggagaaacttatttacctgaaaaaattttccctaatctaaaaatgtcagacctaaaggaaaacttatatacagtgatgaagcaaaaatataatgaacaaagtattcttgcttttgaagatgtacaagccgttaatttagacgaaaatgacagcaagattttaggtgttaagcctggggatgcaagtttgaagatttttagacgggcaatcaatgataaaaatgtgccgatcgagttcactatttctctcgctagaggagatagatttatttatcgatcacgtcaatataatcatttagtttaattattgaaaggaataggctcatgtttactaaaaccgacgcagaactaaaacagatgggtgcagatattactactagagaaattcaacaacagccttctttatggaaagaaacttttaagatatacaaagaaaagaaaacagaaatcgataattttttaactaaaattactaaaaaattcgataaggtaaaagtgatttttactggtgcaggaactagtgcttatgtgggtaatacagtaatgccttatttgagaaagcatggcgaccgtaccaagtatgactttgaagcaattgatacaactaaaattgtttcaacaccagaagattatcttgaagaggatacaccaacaattttggtttcttttgctcgtagcggtaattctcctgagtcagttgcaactgttgagcttgctaagcaattaattactaatttatatcaaattgctattacctgtgctccagaaggacatctggctcaagacttaaaggatgatccaaatggcttagttcttttaatgcctgctaagtcattagaccaaggttttgcaatgactggttcgttttcatgcatgagtttagccactttattagtttttgacactagaagtgatgctgaaaaagaagcaattgttaatgaaattgctgaaatgggccaaagtgtaattgaccgtgaagatgaaattcaaaaactagttgatattaattttgatcgaattacttatataggtagtggtgctttaggtggattagctgaagaagcacgacttaaaattttggaattaaccgccggaaaaatagcagccttatttgatacttcgatgggattgagacatggtcctaagtcatttttagataagaagacgattgtttttgactttgtttctaacaatacttatacgagaaaatatgatttggatattttggatgagattaaggctgatcaaattgttccattagtaatgggagtaggtcagcttaaaaaggggcaagactttgagggaaaattctttgcctttgctggaaaagaagtgcctgatgcatatttagccttaccagatattatgtttggacaaacaattgcattacttacttcaatcaaagtaggaaacactccagatactccgtccccaacaggcactgttaaccgtgttgttaaaggagtaacaattcacaaattcatcaaataaaattcaaattttgaaaacagtttcagactaaaatataaattaatttaaggagttaactattatgtcatattacatccatgcgggaaaattctttttagaaaatagaactgaaaagggaggttatcttgaggttcaagatgatggtaactttggtctatattatcgagaagatgaaaagccgagtcatggcttaattaaagaatatggcgatcaatggattgcccctggttatgtagatacacatattcatggtttgcttgatgaagatacgatgaagagtgactgggaaggcattgacaagatctcaaatggcttattacaagcaggtgtaactagctggttaccaacaactattactgctagtgacaaagaattaacagaaacttgtgaaaagtttgctgcacataagggtgaagaaactggtgctaaaattcaaggtttgcattttgaaggacctttctttactccaaagcatggtggagcagaaaatccaaagtacatgactgatccatcaattatgcttttgaaaaaatggcgtaaagcttcagatgacatgctaattaagatttcaatggcacctgaaagaaaaaatgctcgtcagtttgtacgtgagacagtaaaaatgggcttggtcgttgccttaggtcactcagattctaattttgaagacgctattgggtgtgttgaagctggtgctagcgtatttactcatacattcaacggaatgaatagtttatcacaacactcacctaatattattggtgctgctttttcttcacgtttaacaacagatgaattaatctgcgatggtcaccatgttgaagaaccagctgttcgtgctttggtaaatgcacgtggaccagaacatattgccttgattacagattgtatgcaagcaggtttaatgccagatggggactatgttttaggtgaattgccagtttatgttaaggatggaatggcacgtctaaaagaaactaataatttggcaggtagtattttgctcttaaaggatgcagttaagaatgtagttgattggaatgttgcaacacctgaagatgcagttatgatggcgagttatgtgccagctaagagttgtaatttacttgataagtgtggagtgattaagccagatcacccagctgattttgttgtattaaaccatgatatgactgtaagtgaaacttatttaaatggtgaatcacgttacaaagcttaaaagtttatatctttacaagtaactttagaaaatcttaaaaaagtggttgcaaccagttgactagcaaaacttaatatactaagattgaaaatgtagaaagcgtttacaaagtatttacaaaaaatggaggaatctctatgaatattgtgggagctagaattgatggacgacttgtccatggtcaagtagctaatctttggacaccaaaacttcaagctgatcgtattattgttgttgatgaagaagcagcaaaaagcgacattcaaaaaagtgggttaagaatggctacacctcttactactcgtcttagtgttttaccagcaaaggttgcagccgatcacttaattcatgatcgttatggtaatcagcgagtatttattgtcgctaaaaaaccagcagccttcttagatttaattaacttgggtcttaaacttgataccttgaatgtaggtaccatgtctcaaactgatactactaagcaagtgactaagcagatcaatgttgaggaaaaagacgttgaagactttaagaaaatagcagataagggtgtgaaaatcatagctcagttaactccaagcgatgattctcatgactttatgaaattaatgaacgaaaagattaaataggaggtttaattatggcttggtggcaaatattactacttaccctctatgctggatatgaaattcttgatgaattacaaatttattcatcattgaatacaccagttggagctggcttgattgctggtttaatcatgggtgacttaaaaaccggtttaattattggtggtgccatgcaacttacagttttaggtgttggtactttcggtggtgcttctaagattgatgcaactactggtacagttttagcaacagcattttctgtaagtattaaaggaatgagcccacaagtagctatttcttcaattgcggttcctgtagctgcaatcatggttcaattggacgttttggcaagatttgctaacacttattttgctcacagaattgatcacttaattgaagaaaacaattataagggaatcgagagaaacttcctttacggtgcgattccatgggctttatctcgtgcaatccctgtctttatcgctttagcatttggacgcggcttggttcaaacaattgctaactcattgaatggaaacttaaagtggttaggtactggtttaacagtagccggtgctgtccttcctgcagttggttttgctattttgcttcgttacttaccagttaagaagcacatcgcttacttaattatgggattcacatttactactttattctcagttttatttacaagcattcaaaccttaggtacaggtattcaagcagcaaataaatcatttactgcaactttcaatggcctaccaatgcttgcaatggctttgattggattagcattcgcaatcttacactacaaggatgaaattagtggcaaaggtggtagtggtaaaggcggaacaaaagaagccacaactactacagaatccactaatgtagcttcagagggggaaatcaccgatgatgaactctaaaccaacttataaattaacagataaagactttaatcaaattaacagacgttctctattcggtttccaactaggttggaactatgaaagaatgcagaatactggatatttattcttaatcttgccacaacttcgtaagatttatggtgataatactccagaattacaagaaatgatgaagacgcatgttcagttctttaacacttctaacttcttcaacactattattactggtattgacttagctattgaagaaaatgaaggtgttgaaggtaaagatactgttactggtttaaaggttggattaatgggaccttttgccgcaattggtgactcaatctttgctgcattgattccaacaatcttcggtgccttggctgcttctatggcttctcaaggaaacccagttggtgtatttatctggattgctgctcaaattgctatctgtttcttcagatggaagcaactacggtttgcttatgataaaggagtaactcttgttactgatatgagagaccgtttgaatgctttaactgatgctgctacagtacttggtgtatttatggttggtgctttagtagctacgatggttaacgttaagtttgcttgggtaccacaaattggtaaagttaccatggacatccaaaacaacttagatatgatcattcctaaactattgcctgctttgattgttggctttgtttactggttacttggaaagaagaagatgacttcaactaaggctatcttaattgttttagttctttcagttattcttggcggtgttggtgttcttgctaagatttagcagtaaattaaaggaaaaatattatgacaaaagaattagtgctaatcagtcatggtaagatggctgaagaagttaaaaaaagtgcagaattgattatgggtcctcaagaacatattcatgtagtatgtttacttccagaagaaggaccagaagattttgaaaagaagtttcaagctaccattaacggcattccggaagaagatttaacagtatttgctgatttaatgggtggcacaccagctaacacagttagtcgcttgattatgagtggtcaagatattcacctaattgcagggatgaatctggcaatggtaattgattggctcaatagtcaaatgattggtaatgatgcagattctgtggctgctggtaaagcagggattgtagatattaatcaaatgcttgctagcattaagaaataaatacattaaagaaataaagaatggctcacgttggtaaaacttacgcgagccatttcttttttattgatgcttaatctttaggaagttttaggataagctaatacgtatgaagtataagtaagataaatactagtaaagattaaagaagtgaaaaaatgagaaaattttgttcaaaatgtggagcacccttaaaacctgatgatcaattttgctcaatatgtggtactcctgttgatggtaacagtaaacacgaactggaaaaaataaattctattaagcaaagaccacaagtcaaaagaagtgaaattcgtaattctaagagaaatttcaaaacaagaaatattattatcggagtagttatcgctattgtagtgcttgttgctggagggtgggcaatttatcaacatggccgctcttcagcagaaagcaaaataattggtggtaatggcagactaactactgctgaaataaaaaagatgccaaataaacaactagctgcttgggcaattctctacgcagataaaaaatatggtaaaaaatggggagaagcagcagatgaattaagaagtggacatttaacaattaagagttactcaagccataaatttggcgactacgaaattagtgctacaaatggtagtactttgtatgctgtaaataaccaagtaggatatcttatttctaaagataaaaaagagataacttatgtcggaaataagtcgaattatagtaatagagatgttttagaacaaatttatccagtagttaaatctgaaaatactgaagagaatgtaagtaattggaataataatttaacaattgttaagggaaaagatcgtactgcctcttcaagtacaaaaaaatttacgactgaagaaaagaaagacactaaggcaactaaattatggtcggatgagcagagagacaggttaattagttatatggatgaatttggtgataaaatgcaccaaccatattcgcattatactggtagcggaagtataacaactgcagctggtcaagaatacccgagttttctatcagaaggaaaattcaaattgagttcaggtgataaggatagtcgtgatcctgaagatatggatagtattaacctcaagtggaatccagatgttactgataaagacaatgatagtaatacatacaatgtagttgcaatctttaactataatggaaaaagtgctgaacagcacattacttatcttttttgcttttaccatggagaaccagtagctcttgttgatcaaacaactaatggagaatacaccgtggttcatgcaactgccaaccatgacttaacttctaactttgaagaaattgctaataatgattagaaaaagaaaaatctggtagaaaccatctaccagatttttttatttattaatatacagcaccatcatagaagttgtatcttggacggttgaaatcaaatgtagctaattcactcattttaattacgttgtcagcaacgccccaactcattaaattgattgattcaccatataattcatcaggaattacaagtaaaacatactttccttgagacatagcgtaacctaattccatccctaaaccaacgtcttcttctttaggaacataaacgccaagcataacgtcactagttttaataccaactaagtcaccattataagttgcttgtgcccattctttatcatgtaagtattcgggatgttcgtcaacacgaatatctttatattgattttgaagaggaacatagctgttttctaaatcaatagtaggattagcattgagagcgctcattgcatctttgtaagccttgttttgagtttcagtaaaccaaccagccaccaaaataaactgttttttgttttgtcatggaaaaacctttctttcttattggtggaatattttttacattaactaactttaacaaaatttgctcaaaagaaacacccacttttgtgtttttgaaatcggttttatataatgaaactagaaatttttgcttaggaaaggcggaacctactacgaatactaaaaaaagtcttttcgatccgcaagctgtctttgtaacagacttaactgatcgaaacgagatattcaagaccgtttctcaaaaattatatgacttaggctatgttaaagaagattttttaggcgatattattgaacgtgaagataagtatccaactggaatttcaatgagacctttatctagagaacttccagatgttgcagttcctcatactgaaggggattatgttagcgcacaattaattgtaccgattgctcttagaaattcagcaacttttaataatatggttaatccaagcgaagcattggaagttaagttcttatttttgattttgaataatgatccagatatgcattcaactattttggctaaaattatggactttctagctggaacttcagttgatgatttaaatgaattatttaattcagattcaaatgaagaaatttatgattttttagagaataattttgaaattgaaaaataaaaagaagctgctttgcagcttctttttgtctccagattaaattattaaacttccggataatcagtacttgaaaatgaaagtgaaaagtaatcacaccgtttatagccaataactagttcaactacttcacctgtagtagataaaatagtttttttgacttgtcgtacaacgggataatctttagctatttttagttgcttactaatttcgctatcagcttttacaattgtgtctgtttcagtaaagggctcatcaaatagatacaattgcttatcgctttgcaaggtttcatagatactatgataattattcggatctttagctaaatttcgattaataaatttagctggtataaatgaacggtgcaccataaatggtgtgtcaccaattaaacgtaaacgttcaatatagtagtaactatcatatttgggtaagccgagtttttttaagatttcgctctgcttttcctcttggagtttcaaaactttaactgtatcttcttcttgtttgtttgagaagacttcattatcactaagacgaactaatttatcttttcttgatcgtgaaataaaagtgccttttccttgatgacgaactaaatatcctgccttgacaagatctttcacagctcggataacagtaattgaagaaacattaaacttatcttttaattgagcttcactataaaatttatctccatatttaaatttgccagagataatttcttgctttagctcgttttcaatttgtaaatattttggaatatccataatctatattaatcctcaagatagattctcctaagatccatgatatcactgcttgagagcttcatggtagaacgaaggtattcgttgatgccaccgtattgctggtttaggacgtgtacagcatggtctaagtattctggatagactgactgaatatctttaatagactgcaatacacgcttgctagaaccgtcagcggctgcttgcttaagcatggcatcaacaaaactttttgttgtgatattggttagagtatagtcatatttgatagtagtaaaaggtacacctaatgctgataagatcaataaagctccaaatcctgtccgatcttttccggcagtacagtggaaaagaagagcattcttgtctttatcatttgtaagcaaaaggtcaaagaatttacggtaagctttttgagcagtctgtccattgatcatgtcttcataggcaaagaacatatgcttaaagccaaattcaggatctttttcggcattctcttctaaagcaaagatccccttagatgcattagttaaatcatcactaaaaactggatcaaaaacatatttagcgccttctggaacacgatcaggatgatcatttttttctttttctgttctaaagtcaacgtcatacttaacgccatgcttttgcaataattctaagtctgatgaagaaagatcagctaaattaccagttctaagtaatttattatatttaattgtttgaccggatacagtcttatagcctccaagttcgcggaaattgcgaccattttggatgccaattaatttcgtctcataattttcgctcattagtatttttcctcactatagttatttaaatacagtattattactttaacatattttttcttagatattttatttttctcagatctataaaaagaaaacaaacttattaattggtataattaatggtaaaattacaatgtaaagatacaaattccatgcggagatgattacttatggtagaagattatgacaacattttagttcctgttgatggttctgaaactgcagagcgtgcgtttgataaagcagtaaagattgctcttgataacaatgctcatctggatgtattgaatgttattgatactcgtcaatttatgggggaaatgcaggatactttgatttctggggataccatttatcaaatgacgcaggattccgaagagtatttaaagagtctaaaagaatgggctaaggaacactttaattttactgatgtttcttaccatattcgttatggctcccctaagagaattattgctgttgattttattaaagatcaccacaacgatttaattattatgggtgcaactggtatgaacgcagttgaaagaatgttaatgggtagtgttactgcttatgttaaccaacatgctttatcagatgtgttaattgttaagactgatcttgataataacaaggttgcaaaacctaagaaaaagtacttttaaaaaaagaacattatgaaattcactctatcagtaatgatagagtgtttttttataaagtggatcgatccaattcaataaattaatatttactagcgcttacattaaaataatagtacccaagtacgaatatttttgatatgatacttaagaacgaacgttagtactagggaaagggagaacgataatggtgaatttcgattacaacattataaaatgtaaccaagattcagtggctcgttcttgggctgattccttcggtggatcagtcttcattagtgttggcgctttcgttgtttttttagcgacttttctggctcaatgtgattagctctttttgtcagctcatcatgttgggtctttttttgtatttgtcatttaatgttttttcattaggaggaaatgatgaaaaagttcaaaaaagtcttagtaggcctttttgcaattttacttgctgttgttgcaactgcttgttctaacaaatcaaacagttcaaaggatggttatacaccaaaatcattaactatccaatttgtacctagtcaagctgctaataagcttgaagctcgtgctaagcctttagaaaaaatgctttctaaaaagcttggaatcccagttcatgtttcaatgtcaactgattacaacacagttgttgaagctatgaaatctaaaaaagttgatgttggtttcttaccacctgatggttatgtattagctcataaacaaggagctgctgacgttttactccaatctcaacgttacggcgttaagcaacctggtggtaaggcaactaataaattagttgattactatagagcagaaattcttgttaagaagggttctaaaattaaatcttggaaggatctaaaaggcaagagtatttcagttcaaaacccaacttcttcagcaggttatgttttcccaattgctgaacttggagaaaaaggtttggatgtgccaaaggattgtaagttagttactgttactggccaagaccaagcagttttgaatgtattaaatggtgatactgacgcagcatttgtgtttgaagatgctcgtaacactgttaaaaaagacaatcctaagattatggaccaagttgtcccaatttacttcactaagccaattcctaacgatactatttctgttagaagtgatatgtctaagtccttccaaaagaaacttgcaaaggcatttattgaagttggtgaatctaaagaaggtaagaagattatcgaatcaatttatagtcacgaaggctacactaagtctaaggacagcaacttcgatattgttcgtaagtatgacaagattattgccaaggacaagaaatagtcaattaaataaagcttagttagtaaaagataattgtctctaaaagacgattatctttttatgcactgtagtcaatttaaataatgttaaggagatttttaaattaaatggcagctactaatcagccgatgattcaactaaaaaacgttagtaaaatttatgataacggaacagttggtttaaaggatattaacttaaatattgataagggagaatttatagtagtagtaggtctatctggtgcaggtaagtctactttacttcgttcaattaaccgtctacaagatgtctcagaaggagatattataattgatggtaaatcaattacttctgctaagggtaaagacttacgcgaaattcgccgtgatattggaatgattttccaaagctttaacttggttaaacgttcaagtgttttacgcaatgttttaactggtcgagtaggctactatccaacttggaaaacaacttttaacctatttactaaggaagataagcaaaaagcatacgaagcgctccaacgtgttgatttagcagataaagtttatactcgtgcggatcaactttccggtggacaacagcaacgtgttgctattgcccgtgtgcttactcaaaatcctaagattattttagctgatgaaccaacagcttcacttgatcctcaaacttcacgtcgagttatgcatgatttgaagatgcttaatgaagaatacgggatgactgtagttgctaaccttcacagcgtagaacttgctaaggaatttggagatcgagtaatcggtgttcgtgcaggtcaaattgtttatgatggtaagatgagtgaaacttctcaagctgtctttgacgatatttacaatggtggaaatggcaagaaaggggaagaagatgcctaaatctaaggaacagcatttagctgaattgcctaaaaagaaattcaaaattatgaaccttgtatgggtcgtaattatggttttaggtctctttctttcagtagatgtaacaaatacccatattagtgttttatttaataactttagtcaattcactgatatttttgttcaaatgtgtcaccccgattggggatatgccgctacggcagttccacttttaattgaaacaattaaaatggcaattttaggaactgtaatgggatcagccatcgcctttgtttattctcttttaatcgctagaaatattgttaagaataaggccgttactggaattctaagaataattatgaatattgttagaactattccagacctactcttaggtgcaatctttgttgccgttgtaggtattggtccagttgccggtgttctagccttaactgtatttacatttggtgtggttgttaaattattctatgaagcaattgaaacaattgacccaggtccaatcgaagctttaacagccgttggtgcaaataaactacaaattattcattttgctgtgatgccacaaatacttacttactttatttcttatgttttatatgcatttgaaattaatgtcagagcttcaacagttcttggatatattggtgccggtggtattggtttgtacttacaacaaactcttcaagtctttgactatgctaagaccggtatgattatcttagttattatcgttgtcgtagttattatcgactacatttctactaaatctcgggaggcgttgatgaaataatggatactacaatgaaaaaattacctcctaaaccagtggatactaagaagaaggttcaacactggacaattgccattgttactatcattttaattatttggtcatttgtaggaatggattttggcggaataaaagcaagtgcaggtcaaatcgcaggagctattgttgccggaatttttcatccagattggtcatatgtatataacggaagtggtgaagatttaatttctcaattatgggaaacaatctgtattgctttcttgggtacttttatttctgcaattatttctttacctttcgccttttgggcagctaatactcgtcataagaaatggtatacatcccgttcaggaaaagttgtattagccgttattcgttcattcccagaaattgttttagctttgatgtttattaaggcagtaggaccaggttctgcagccggtgtactagctttaggtttccactcagttggtatgcttgctaaattgttttcagaagcaattgaaaaccttgaagaaggtgcaaatgaagccgttactgcagctggtggatctaagtttaacattattatgtttgctactatgcctaacttaatgccagccttgatttctaatactttgtatcgatttgatgtttcaattcgttcagcatctattctaggtttagttggtgctggtggtattggttatccattaatcattgccttgcaataccgtcaatggaatcgtgttggtgtaattctagttggtattattgtcatggttgttgttattgactggatttctggctggattcgaaagaaattagtttaattaattagtaaaacatgtagtttatctaaactacatgtttttattttggtaaattataaatttttttgtaatatctacctataatatggataagtacaggaaaaaaaagaacttttttgttataatggaagttgtatttcaaggaggacaatatggataatttaactaccatgacattggctgacgatatggctttatcacaagaaaagattatcaacggccaacaagacctgaataccaagagaatttataatgaaattaatagtttggatattcttgataagccaatcgaagaatactttgatatgactcaagatgaatactacaatagtgaatctgatggtaaattaactttactacatttagataaaccattacgtgaattaaatgatcgtattttaactaaccacgtagatggatatgtagatcaagacgagattaatttaacctataatcatgaggatccattgcaagatggtagctatgatcgtgctactgatttacatgtacttttatatagtttaaaagtcattggcgctgtgagagctattgctccgaatgatttgaaaaaggttttgtctaaagatgcggttttatcattgggtcttgccgcaaatgctttggcaaataattaaccccaaggccaactaaaggcctttttttgtgtgatgagtggggaagagtatcatgaaaattatcaagaaaaccaagggtatgattgataaattttccggtgttacccggaagatgatgcgaaagaaaagtaatattccatttgatggaatgcaaaagtatatgactgttggtgagtataacgttggagcgcctgaaggaactccacatggtgaagaatataagcttattgtttataaagatactgacaatgtcttacaccaagctttacgttcgattaatgcgtctgatctagcaccagcttatgttcggaagtttgataaaaggctaaatcgttatactgcatttgttaataagcagacaggacgtcgttatatcgttgaagatcaactagatcagttagtagattatgtaaaaaagcatagccgagatggctataactcaattaatatcggtgttttaaccgatacacactataaagatgctgacagtattgatttttatgggcataacggacttcgtcatgttaaagagtttaattatcttgaagataaagatgttttagatttaaaggctcatttaggtgattggatggatggatccgatccaggattagttggcgaagcagagttgatatctttgtctagaacgtttagatctaaaaaaactaactttgctgtcatcaaaggtaatcacgatgaaaatgataaatttgatgagcaccatgatctgagagctagttttccggaaaatgaatttgaagatataatgtggccaagtatgtatgcgcaagatggtattcactatatcacgcgcaagcacggggttgcatattttgataaagatgatgtcagaatcattacggtcaatacatctgatttaccttatgagctagatgagcaaggtaagaaaaaatacgatactaaacttgctttagcgattcgtgaagatcagatgcaagaaattatcgaaattcttgaaaattcaaatggtaaaacaattattttcatgagtcatgcaaatcctattactcgcaagggaacgaatgccttgaaatttaatgggcgttctctacatgaattaatggttgccttcaatcaacgtgaaaaaggctatcttaattcaagggatgttcctcctgaatttaccctagctaatagctttgatttcacaaagataaaaaatgcaaaaatagttgcatatttatgtggacaccgtcatactgaagaccaatatcgcattaacggtatacaatatatattttttaattgctcggctctcatgggcccaaaccatgcgcttactacgcaatacaataagcgctggaatagacagatggatcatgctaatgaagcagctggatatatagtaaatgttgatgttcaaagacatttattacaagtatttggatacggagctgcttctaagagacgattctatcgaatttagtttttgaaatgtaaatagcttataataagactactgtttattttgaggtgaaagttacttatgtgtggaatttgtgcgttttttgatcctgaattaaaggataaagactgtgctattcaaggaatgatggatacaattaaacaccgtggtccatcttccgatggaaaatatactaatgataaggtggctttaggttttagacgtttgtcaattattgaccttcgtggtggaagtcaaccaatttttaatgaagataaaagtagagcaattatttttaatggggaaatttataattttaaaccattaagaaaagaattaattgatgcaggtcatacctttactactaaggctgatactgaagttttacttcacggctatgaagaatggggaatggatggcttattgaagaaagttcgtggtatgtttgcttttgtaatttgggatgacaataccaagactttatatggtgctcgtgacttcttcggaattaagccaatgtactactcagaccaaaatggtaagttaattgttggtagtgaattgaagagcttcttagcttacccaggctttaaaaaggaattaaatactgaagcagttaagccatacttaatgaaccaatataatgacttaaaggaaactttctttaaaggtgtttaccgcttcccagcaggtcactggttcgaatataaagatggcaaaatgaagactcatcaatactgggatgctaagtatgttgaaaatagcttaagttttgaagaaaccttagacaaaatcaatgaagacttaaaagaaactgttgatttatacagaaatgcggacgtaccagttggtgcattcttgtctgaaggtattgattcttcttacttaactagtttacttgatcctgaagatgtcttctcagtttcttttgatgattctacatataatgaagcatcaaaagctaaggcactttctgacttacacggctggaaattctttgcagataaagttgatgcagatgaagcaatgcgcgacttcccagaaatgcaatatcacatggacgaaccagatgctaacccatctattattccattatggtacttgtgtaaattagctagaaagcatgttactgttgcactttctggtgaaggtgctgatgaattatttgcaggctacgttaactatggaatgcatacccataatgatgtaattaaggtctttactgctggccttaagaaattacctaagaaaagtcgtgttcgtttagctcataagattaagaagatgcctaacttcccaggtaaagtacatatgtacactaacttggcagagccaagtgaattttatgttggacaatctgtcatttatgatatggactatccaactatctttacttctaaagatgctaatggtattttgcgtgataaatacaagaatgatctgacagttaacggtatttatcaagaagactttaagaaagttaaaaatattgatgaagttaagcaaatgcaatatattgatcttcaccactttatgcttaatgatattgagcaaaaagcagataagatctcaatggctcactctctagaattacgtgtgccatatcttgataagaagattgcagaacttgctaactcaattccaactaaatatttagttaaccggcacgatactaaatatgctcttcgtaaagcatctgagaaggtcttaccagaagaatgggctcaaagacctaagcttggtttcccaactccaattaagcaatggcttaaggaaccaagattttacaaacaagttagagcattgtttactgaagactttgtagatgacatttttgaccaaaagaagattgttaaattgcttgatgataactacaagggcgatggttcagctcgtcgtcaaatttgggctatttacactttcttagtttggtataaattattctttgttgattatgatgaaactgttaagaagtatcaacatgttcaaccagaagtagcagaattaatcgaaagtggcagacttgtttaattaaagttagagagaagtacggatacaaaatggtacaagcaaaatttactcctattttactcggtagtgacatcaatgtttacggaatggctcgctccttcaacgaagcttatggaattaaggttcaagcttgggctgctagtcaattagcagcaacgcgctattctaaaattgttgacgtagaagttcatgaaggctttgaagaagatccaggctttatgaacgttatgaagcaaaagattgaagaatacaagaatcatccagaaccagttattttaattgcttgtggagatggatacgcagaattattggctaagcataagggtgagttgaaggatacttttgttgttccttacattgattatgacttgctagagaagctaatttctaaagaaggtttctacgaaattgctgaaaaatatggtcttccatatccacatactaagattgtgactatggatgactataaggctgaaaattatttgaatttaccatttgattatccagttgaattgaagccagaagatccagtttcatggttgaattgtcaatttgaaggccgtaaaaaagcctttactattcacgatgaggcagaattagtagatatcgttggtaaaatctataccaatggttatactgaagacttgattttacaagatttcattccaggcgatgattctaacatgcgtgttcttaatgcttatgttgataaagatcacaaggttaagatgatgtgcttaggtcacccacttcttgaagacccaactcctcaatctatcggtaattacatggcaattttgccagccttcagtcaaaagctctacgatactgttcaatcattccttgaaaaattgaactatactggtatggctaactttgacattaagtacgatccaagagatggagaatacaaattctttgagatcaacctccgtcaaggtcgttcaagtttctatgtaactttaaatggctataacttagctaagtggtatgtagatgattatgttgaagataatttgaaagataagccaacagtttatggaaataaagacggtgctaactatatgttgtggcttggtgttccaaagaagatctttaaggaatatgcttacgacaacggttcaaaacgcctagctgaaaagttaattgacgagggtcactatggtacaactgtcttctatgataaagatcgtagcttaaaacgttggttattgatgcactacatgttccataactactatgctagatataagaagtactaccaagtaaataagggacaatattttgaagaagaagctaaaaaattagaaaagcaagctcttcgtgatggtcaacaagaaaaccatgagaatgaaatttaattagaaaagtactgctgagaattttttactctcagcagtatttttttgactactttactaattatagaaaattttgaaaatgagcctctctcttgctagacgtgacttttgcttaatacaatatatatgatccaaaatgtcaatacctacaatatcatgtagtttctgatagaatagaaccatagatattgtgaaagaagagaataaccatgttacaacaagatgctcaaattaaatcaattactcaaatgacactgccagaaacagctattaaaagagacggcagcatctatccttttgctctttacaaaattgaaatggttttagatagcttgcatctgactgaacatgaagcagatattttacctgctatccttcaaaaattaaatggtgcaaagcagacttctactgagaaaatagcagatgcatttgttcaaacattaatcgaactcggctttagtgatgaagcaaatgcttatgttgattaccgtagagaagatgaagctaattttaagaagcaaactgagactactaaccgtctgggacgtttaattcaccatgatccaacaattgttaatgaaaatgctaataaagattcacgtgttttttcaactcagcgtgatttaacagctggtgtagttggtaaaacaattggtttaacgatgatgccagaacatattgctaaggcacacttgcgtggtgatattcactggcatgacttagattacacaccgctcagtcctctaactaactgttgtttgattgactttaaagaaatgctaggtcatggctttacaattggaaatgcaaatattgaatctcctcattcaatcgaaacagccactgctcaaatgtctcaaattattgctaatgttgcttctagtcaatatggaggctgttctgccgacagagtagatgaagttttggctccatatgctgaaaagaattatcacaagaatattaaagaagctagcgaattttttgacgatgaagaaaagatcaaggcttttgcagttaagcgaacaaaaaaggatatctatgatgctatgcaagctcttgaatatgaaattaatactctattttcaagtcaagggcaaacaccattcactactttaggttttggactaggaacatcttggattgaacgtgaaatccaaaaagcaatcttaaagattagaattgagggtttaggaaaagataagagaacagctatctttcctaagttagtctttacgctaaagaagggacttaacttacatcctggagatccaaactatgatatcaaggaattagctttggaatgttctactaagcgtatgtatccagatattgttagttatgacatgattaagaaaattactggatcatttaaagctccaatgggttgtcgttccttcttacaagggtggaaagatccagaaactggtaaagaagtaaattctggtcgtatgaacttaggtgttgttactttaaacctacctagaattgccatggaatcaaagggagacaaagatttattctggcaaatttttagagaaaaagtccaaacagcacatgaagctttacaaattaaggctaaacgttgtactgatgctgtacctgataatgctccaattctttatgaatatggtgcttttggtaaaagactaaatgcagaagataatgtaaatgatcttttcaaaaatggacgctgtacagtttccttaggctatattggactttatgaagttggtacagtcttttatggtcctaattgggaacataatgaggaagcgcaccaatttactattaatattgttaaagaacttcacgattactgcgctaaatgggaaaaagaagatccaaatcactatcactacagtgtatattcaactccaagtgaaagtttgactgatagattttgtcgcctggatactaaaaaattcggtaaggttaaagatattactgataaggaatactacactaattccttccactacgatgtaagaaagcatccaactccatttgaaaaattagcttttgaagctccttatccattttatgctgcaggtggatttattcattattgtgaatatccaaaccttaagcaaaatcctaaggcactagaggctgtttgggattgggcttatgataaagtaggatacttaggaaccaacactccaattgaccaatgctacaagtgtggttttaagggtgaatttaaggcaaccgctaaaggctttgaatgtccacaatgtggaaatcatgatccagaaacttgtgactgtgtaaagcgtacgtgtggctatctaggcaatcctttgaaacgtccaatggttcatggtcgtcatgaagaaattgtccaccgtgtaaagcacttgaatatgggaatggaagaaaagatggctaaggatgaagttagaaagaatgacgaatactgatgccagagaaagataagaataatcaagaaggtcctgatgttcgaggaaatttaattaaggttaatgttggtggagatactatttttgttgattctaatcaatataagccgcaagttgaacatgctaaaaaattaaaacaacaacatagaaaaccgaagaatcctaagccccaagaatggaagtcagaagaatactctaagcataaaattgctgactataagccatttaactttgttgatggtgaaggggttagatgcagcttatatgtgagtggatgcttgtttgactgtcccggttgttataatttagcagcccaaaattttaattatggacgtccttatactcaagaattggaagataaaattattgaagatatgtctcaatcctatgtacaggggctaactttattaggcggtgaaccttttttaaatacttgggtatgcttgaaattaattaaccgggtgcgtaaggaatttggacatagtaaagatatttggtcttggtcaggctatacctgggatgagcttcaaaaagaaactcctgataagaaagaaatgctttcaaagattgatattttagttgatggacgtttcatggatgatttgaaagatctgacactacaatttcgtggttcaagtaaccagcgaattattgatgttcaaaaatcaatcaaggctaataaggttgttatttgggataaactggttagataaatttgatagaataagggaaacaagagagtttctcttatttttttaggtgaaaagatgcaagaaaagaatttggaattagtagataaaattatgaccgctcttcaaggtgtcgaagatccagagttgttgattgacgtagtcaatctaggcttgatttatggaatcgatattgaaggagatcatgcaacaattaagatgaccctaactattgtgggatgtcccttatctacatatctacaaaacgcaattgaaaaagcagttttgtctgtgccagaaataaataagtgtgatataaagttagtttggtatccagtttggaatccagagcgtatgacagtagctgctaagaaacaattagggatacttgataatgagcaggcccttgaccaagaaaatgaaattgaagagacagaagaaaaagagaagataattgatttttctgttccaataaaaaagctggctgaagaatatccagattttattcaaattatgtatgactgcggctttacaagaattaaaatcccaggtttgttgtctactgtaggaagagtaatgacgattccacttggtgcgcaggctatgaagattgacttagataaagtaaagcaggcgttcgaggataaaggctacaaggtgattgattaatgaaagaactagataaagaacgacaacaagctattttaaaaattttaaattttattcaagacggtggagagcttgaagaagcaaagaaaatgtttcaagctgcctttgatcaagttgatgtagccgaaattactgcggcagaaagagaattaattgcacaaggtcttgatccaagaaaaattcaatatttatgcaatgttcatgctgatgtttttaagggtaatattaaggaaaataaggagaattctgagtttgaaaaaccaggtcatcctgttcatacattcaagttagagaatattgttcttaagtcattggtaaatgacgccttattaccagaccttgctaagtgggaaaagggagataagagtgcactctcaaagttaaggcaggagttaaaagacctagccaaaattcattatcattatgctcgtaaagaaacttccatgtttcccattatgactaaatatggaattactgcaccaccgaaagttatgtggggcgttgatgataaaatccgaaaacttattggtcaagctaatttacttattagtcaaaaagatattaataaggctgaagtgtctaaggcaataaaagagacagcacatgaagttcttgaaatgatttttaaggaagaagaaatcatgttgccaatgattgatgaagttgctagtgaagaagactggggtaatgtcaaaaatgaggaagagcagattggctataccttgattcaaaaaccaatgaattggaaacctaaggaaaagccgaaaagtgatgggcctatttctatcgataaattaagtagcttagcactaaattttgcagaagggagcttaaatttagaacaattatctgcaattttggatttattgccttttgcattaacttttattgatgaaaatgataaagtagcttattttggcggaggcgccaatatttttccccattctaaaaatgcactcggcaatagtgtttattcttgtcatttacctgagagcgtaccacgagttaaaaagatttttgacgattttcaccaagggaaaaaagataagtatgagttttggtttaagccaagacatatgggacgatacttatacttacagtattttgctgtgagaaaagataataaatatttgggctgtttagaggttgcccaagatgttactgatattagaaattggaagaatgaaaagaaataattagaagactctacctttgggcggagtcttttttacgctcgtgcaaaaatgtttattaattgctagactgaatgtaagaatatagaagaaaagggtgagagagttgcataataagggaaatattcaaccagatgatgagataaagttacattggcttcttttaggtgagttatttacctggattggagccagttttatttggccattaacttcagtttatttgaataaaagactccatgtttctttagctatgattggaatagtacttttatttaattgtttagctaatatgcttggttcatttattgctggctgggcatatgatcatttcaatccatactatttaattatcgccggcgctggtttagatgccttagtactatttgggatggctgctaatcatacttggccaatttattgggtttggatgactttgaccggtctcctgggcggctggaacggtgcgttaattaattcaattgcaactagcatcaagtctaagcccggtcgatatgtctttaatacaatttattttgcacaaaatcttggtgtggtattagggacattaattgtaggttatatctatgattattcagttacaattttatttataattgcggccagtctttttgtgattgtaagtataaatgcagtaattaattatcgaccgattattaagtttcatttagaaagaaaagctcagcaaaataaagatagtaaaaataaggcaactccgatgcctgctgccaatctaaagctgactgttggctttttcactaccttagctgtaatttggttaatgtatatgaactgggaatctaacctttcagtttatatggtttctttgggaataccttttcatttatatagtttattgtggacaattaacgcaggtattattgtaattgttcaagcatttttaagtcgtttccctaacacatttaagaacttgtttcatcaagtagtatttggggttactatgtttgctatttcttttgtaaccttaatctttgcaaaagactatgctcactttgtattttcaatggttactttaacgcttggtgaatcaacagcaatgccggcgatgcccgcatatgtaaatgacttgtcacctatcgatagtaaaggtaaatatcaaggcttaacaatttcaacgtcggctgttgggagggcatttggccctttatttggaggcttagttattgataagtttggctatatcaatttctttattgttgccgcatttggtatttttatgatgttagccattattgttccccttcatacgagattaaaaggaaagttgaaaatatttaggtaaacttttacatgatttttcttattaagtgaaaagctttacagaatgaaagcgatctcttctttttatgaaagcgccatcttataatataaatgtgcggtaaatgaaaaggagatacacgatgagaaagatttcacctgaagttgcaaaacatatggataatttatctaatgaggctggagtaatcagcgcattagcaattgaccaaagaggatcattaaaacgaatgttagctgaggcagcaaataagcctgctgatgaaacaacaattgttgattttaaggaagctgtttctagtgagttgactccatatgcttctgccattttgacagatccggaatatggtcttccagcaactaaggttagagataagaattgtggtttattattatcttatgaaaagaccggttatgacactactgaaccaggtagaatgtgtgatttaattgctgatcaatcagcattaagaattaaaaatgatggtgccgatgcagttaagttcttactttactacgatccagacgaaagtgatgaaattaaagataaaaagaaggcttttgttgaaagagtaggagccgagactaaagcgaatggattgccatttttccttgaattattaacttatgatgggaaaattgatgatgctaaaggtgaagagtacgcaaaggtaaagcctgaaaaagtcttcaaaactatggaagaattttctaagcctcaatatgatgtaacagttctaaaagttgagatgccatttaatatcaagtttgtagaaggctataatggcgacaataacgttgtttacacacaagaagaagcaaagaagttattgaagaaacaatcagatttaactgatttaccatatatctttttatctgctggtgtaacttcagaagaatttattgcagaaattaagatggctgaagaagctcgtgctgactttaatggcgttctttgcggacgtgcaacttggaagccagcaattaagccatttgcggccgaaggagaaaagcaaggtagagaatggctttcaactgaaggaaagaaaaatatcgaaaacttgaatgatgcccttaaaggtgccaaatcatggaaagataagttagaaattgaagaataataaatgaattaactatcgaaaaacaaggtcagaattggccttgtttttttgtgtatgcataagtttagacgtaacttgaaaaaacgtatttaacgcaataaaataaaaaaggaattgttaatttggaggaaaaaatgaagggattaaaatatacaagtttggctgttgctgcattaacagctactcttttagcaagtactaataatagtaaagttcaagctgctacagttgataaaaataacactgttacagttgctaaatcagataaagaaaaattacaagatgctgttaaccaagcacaaaactcggttaataatgctcaagcaagcgtagatagtaaaaagagtacattaactgacgcacaagcacaggcaaaagcaccaaacgatgcttgtgatgctcaacaagctaaggtaaatgatagccaaaagaatctagctgataagcaagctattgcaaagcaagcacaagataagttagatagtgcaagtgcagtagcaaagcaagcaacttctgaaaatattcaaaagactcaaaagaatattgctgcacagcaagatgcaattaaagctgctaagcaaaatgtcagtgatgcaaatgcagatttaagtacagcacaaagtcaattggcgactgctaagcaaaaacaagctgatgctcaaaatttagttaacagtaaagaagctgcaaagaaaactgctgataataatgttgctaacgctgaaactgctgttaagaatagtggactagatgaagcaaaacaaaatgttcaaaaagttcaaaacgcattaaatgatattaagaagacaaatgcggataacgaatcagttttgtctaagaatcaagctgttttagctgaaaataatcaaaagatagcaactgttaataataatcttgcagtggcaaacaaggctgtagtagatgctcaaaacaatgttaatgctaaacaaaaggcgctggctgatgcacaacaagctttgaaagacttacaagatcaagttgctcaagatcaagcaagcggagcagctggtttctttaaggcaattgctgacaataaagataattctgaaagtttaagagaagatgctcaaactgcatataatatcatcactggtcaaccaaatgcttaccaggatattactgtagaatgggctaaggaagctgttaaattaggtcaagaaaacgactcaacttcattaagtaatatagaaaaggctcttggatactatcaacactggatgacatatcgcgataagtatggcttaagccatccatcaatttctttgacagctgtggctattgccatgcttagctcggactttcaacattactctgatgaatttaatcatcctagtttattaactagtaagtatggtccattttatagcgatgaagaagatatatcagctggagaggttaacccaattgacaattggatgagtgaaaaagacgatattgataaatatattgaagctcatccagatgcagctgcttatagttttgaaagtacccatcctctaactcaagatgagtgggaaaaagatgttgatttttggaacgataaaccagtatatattggacactatacatccatgattaagccagatgctaactacgttggattggctggaaatgaatatgaaattcaaccaatgatgaataatgcagatagtatggatgaaattatatttaatccaatcaatggaatagattttaatagttaccaaaacttagttcaatcctacttgaaagatgttaagcaagaagataagattaatacccttaaagctaacgtagctactgcaaatcaaaacctagttgcagcacaaaatgcagttaaatcagcacaaaataacgttcagagtctacaagctaacctagcagaattaaacaatggttctactaagatcaataaggcaatttcagatacacaagctgctcttgctaaaggccaagaaaatctggaattcgaacaaaaacaactagatcaagcaaatcaaaccttagcagatgttcaagctaaagttggtacaaaagcaaaggctttggaggatgctaaagctgcccaagctaaggcagcagaagctgtagctcaagcacaaaatgttttatctgaagctactgctgctgttaaggcaagtcaagctaaggtagatgcagcacaaaatgatgttcaagctaaagataataatttaaagagtgtccaagctgctttagattcattgaatcaagctttgaacaatttagaaaatgctcaatcaaatctttccgctgctcaaacagcttttaataaggctaatgatgacgtaactgctgctaataaggcagttaaagctcaacaattaatcttagatactttgaaggaatctaaatctaaagctgatgcacaagttacaaatgcatcagaagaacttaagaaggcagaagcagaattagctgctgaacaaagtaagcttgaagatgctaaggcaaggttagacgcatttaataagaaagaaactgaaaacagtcataaagaagcttctaatgctgaaaatcctgtaaccccaaccaacaaacctgacaccagtcatgttgtaaaaccttcagataaaactgatgaagatagcactgtaaagccaacggataagccggattcacatagtgaagcatcaacaactaattcatctgaaactactacaactgctactgagtcagatgtaaaggatactgatactgtaaaagaaaatgctaaggcagatcttaagactaacaataagtctgaagaaaaatcctctactgttaagattattgataatagtgatagttcagccgtatctgttgtcttaaacggttcaaatactccagttaagacctttggagaaaagacagttaacggtactacttactacaaagttagtgcaaaccgctgggttaaagatgataaagctcatgtagttgctgtaactggtaatgtaactactaataaattgccacaaactggtgcaaagaatgaactaattgcagctctttctggattagcagtcgcaggtactactttggttagttaccttggcattaaccgtaagaaaaagaataattaatttataaaattatatatcgatagaaaaagagttgatagatcaacgttgaaaaacgaggattatcaactcttttttattgtctagcaaaaccggttctaactgaatatgcatctgaaaaaatacgagtcatgatttgtaagggtaatctagagcgtacctcataatcaggaaaataattggtttttgacatgtagcccataaaagtcaatgtcgaaagcgaagcaagttgtccattaggattagtggtaaaggtaatagtaggaacatcatgacgtgataaattttgtgcagcttcaactaattcgggagtattaccatttaagctaataaaaataactaatgcatcttctttaattcttttggaggccgtcttaataatatttggatccgaatgaaattcaacatacttacctgttaattgcaatttaaccataatttcttgtccaattgattccgatagaccacgtgcaaaaatatagactacctttgcttgtttggtcattgaaatactatcttcaatgttactgtagctaagattatggagagtgttgttcatttcaatttcatttttggtaatcacactcttaattttatcgtctgcatcatttaagacatcaaaattactattggaacggtcttgcaattttagtgactctcggtaagaggtatagccgctatagcccattttttgcatagtcctgacgattgtagcagttgaaacatgagcaaattgacttaatttaacaattgacatttttgcaattttttgtggatttttttgaactgtttcccacaaatgtagttctgcattactaagatcattattttgcatgtatgtgccctctctgtaaaactttaccacttattcaatgaaacgctttcaatttagaaaaaccttaccttcttatctaagtatactaataatgtaagcggtaagaaaaggagaaaagctcatgatttatacaataacacttaatccagcaattgatttggtaattattactaaaaaattagagccaaatattgttaatagaactgagaactttgagcttcaacctaatggtaagggtgtaaatgtatcatttattttgaaaaaaatgggtatagaaaatgtggcgaccggaatcggaggcggctttacacttgattacattacagcaggtttaacagaaaaaggcatcagcaataattttcttaaggttaaggaaccgactagaattaatgtctttactcgggtaatagatcaaaatcgagaatataaagaagtaaatcctggtccagaagtaagtgaaaaagttcaagagcaatttttaaagtatttaaggacaacactaaaagaaagcgatactttaattatttcaggaagtttttctagagggattaaccaagactacttagttaaaattgccaaagttatggctgataaaaaagtaaaactagtaattgactctagttctaaggcagttttagatactttgccttattatccttatttactaaaaccaaatgatcaagaattagctagtttttttgatttaaatgaaaaattggatcaagaaaaaattattaaactagctagaaagctgattgatgacggttgtaaaaatgttttagtctctcttggagattcaggagcggccctcattgataagaatcatgcttattttggtaatgctcctaaaatttcagtcatcaacacagctggagctggagataccatgctcggtacatttattggaaaaaaagaattgggatgtaacacggtagaggcattgaaatttgcaatagctgctggtagtgatactgcgagtcgcatgggactaacagattttgaactagaaaaatatttaaatgagattcacgtaagtgaagttaagtaatagaagggatgaaaaagatgactcaatatgatttagtcggagcaactgggtgtgcaactggtgtagcacatacttttatggctgaagaagcattagagaaggctgctgaaaaattagggtattcaattaaaattgaaacccatggtcaaacgggtgttgagcatgaactttcaccagaagaaataaagaatgctaagggtgtagtgattgcttcagatgtagatgttgatccagaccgttttgctggtaaaagagcggtgattgtacccgttgccaaaggaataaaagagccagagacactaattaaggaagctctaaatcctgatacacctatttacaaacctggacaaccagctaaaaaatcttctacagctggaaatagcgctgaaaatttaggaactaaaatttacacgtctttaatgaatggtgtttcccacatgttaccttttgttgtagcaggtggtgtgctaattgctgtctcatttttctggggaatttattctgctgatcctaagagcagtcagtataatcaatttgcttatatgttaaatacaattggtagtacgacgatgggattaatggtcccagttttaggggcttttattgctgaagcgttagctaaaagatcaggcctagtcgttggttttgcggctgggatgattacaagtgttggcggcggtggtttcttaggagctattattggtggttatctagcagcaattgtagttctcttacttcagagattgttaaaaccacttcctgataaagaatttagaggactaaagtcaatttttttacttccagttttaggtgtattcattactggagcaattatgttttggctcaatggaccaattaaagcaattaatacgggtatgatgtcctggttaaagggatttgaaaattctagtccaattcttttaggaattattattggtgtaatgtgtgcatctgactttggtggaccaattaataaggctgcttatgtaacaggtacagccttactagcacaaggtaactactactttatggccggtgtatctgctgcatgtattgctccacctttagcaactggctttgcagttttattaaataagaaggcatattccaagaatgaacgtacagctggttatgttaattttctactaggatcaacccatattacggagggtgctattccatttgctgcaaagcatcctttatggaatattcctgcatttatggttggatcagcaattgcggcagccttgacttatatctctaaaattcaagttccagcccctcatggcggattcattattttaccattagttaacaaaccatttttatgggtattatggatcgtaattggttcattcatttcaggaatcttattagctttgattgctggtagatttgcaaaaagagagccagaatttgaagatggccctgatctagatgtatttggtgaagaagaaaatgtcaaaaagcctaaaactgtagaaaaaaataatgctgttacggactataatccaaatgatattttggaaacgcaaaatattgaagtaaatgttgatgtacccaataaagactcagctttaaaatacctagctaatttagcagtgaaaaatgggttggctactagtagtcaagctgtctatgataagtatttagttcgtgaaaaagaaaattctactggaatgacagatggctttgctatcccgcatgcacaatctgcagctattaaacagtcagctatgttaattttaaagctaaagaatccgattgagtgggattctttagacggtcaaaagattgatactgtaatttcatttttgattcctgaaaaggatagtaagaagcacttacaatatttgtctaatacggctaaattgttaacacatcaagatttcattgagaaacttaaaaaagctcagacaccagaagaaattaaaaatttgtttgctaacaactaaaaaagaaaactgccagaaatggtagttttcttttatgtttaatcatagactaataattttaataatgatatcatttatataattacttatgacttacaaggaggaattttattaatggcattactcaatgtacgtggcggtgctggtgacattactaagcccgatcttaatgcaagaccacaagataatctttacttagcagtgaactctgaatggattgaaaaagcaaaaattccttcagaccgttcaagaattagttcttttgatggtattgatttgaatattgaaaagagcttaatgcaagatttcgcggattttgcagatggtaaaaagaaattgccaaatgttcctaattttgaaaaagcagttgaactttacaaaattgctaataactttgacaagagaaatgaagacggggcaaagccaattaaagctgaccttgaagaaatcactagtttacgtaatttaactgatcttaacttaagagcagctgatttttacaagaatgcttttgacttaccaatcagtgtgtcagttgatgctgacatgaaggatactaaagttcatgttgtgtactttggcggacctggcttattcttgcctgatactactacctacgacaatcctgcagcagctgatttattgaaggtattacaagatcaatctgaaaacttacttaaaatggctggcttaagcgaagaagatgctaagaagtatgtggaaggtgcattgaagtttgataagaaactttctaaggttcttaagtcaactgaagaatgggcagattacccagcaatgtacaatccaatgcctttatctgaatttgaagataagtttgatagctttaagattgacaacttcttaagtaatttatttgctcaaaagcctgagaagattattgtcactgaaccaagatttttagatcatgttgaggaattgatcaacgaagataattttgatgaaattaaaggctggatggttgttaagtttattaatggtgtagctgcatatctttctcaagacttccgtgaagctgcttttccatttagtcaagctttatcaggtcaaccagaattgtcttctggtactaagcaagcttaccgtttagctaatggtatgtttagcgaagtagttggtgtttactacggtcaaacttactttggcgctgaagctaaggctgacgtagaagatatgattcataagatgattgacgtttatgaaaaacgtatctctgaaaataattggctatctgaagacaccaagaaaaaagcaattgttaaattacgtgctttgattttgaagattggttatccagaaaagattgaagaaatctatgatcgtcttcaagttgtccctgaagcagaaggtggtagcctttactctaatgaaagcgcagctgctgtagaatcagttaagtacaaccttgagaaattaactcaaccggttgatcgaactgtatggctcatgcctggtaacttagtaaatgcatgttacgatccacagagaaatgatattaccttcccagctgcaattttgcaaaagccattctatgacttgaaacaatctcgtagcttaaactacggtggtattggtgttgttattgcacacgaaatttctcacgcctttgataacaacggtgctaaatttgatgaattcggtaacttgaagaactggtggacagacgaagactttgaggaatttaagaaacgtactcaagccgaaattgatttatttaacggcattgaatatggtccagttaccttgaatggtaaacaaattgtttctgaaaatattgctgaccaaggtggtttgactgctgctgttgaagctaataagggtgaaaatggaaacatgaaggaagtatttgaaaactttgctcgtgtttgggcaaacaagcaacttcctgaatcgattaagacacaagtttcagttgatgttcatgctcctggtcctgaaagagctaacgttcaatcacaatgccaagaagagttctacaaggcatttgatgttaagccagaagatggtatgtggttagatccagaaaaacgtgttgtgatttggtaaaaaataaaaactaattttagaatcaaatggcgaaagctgtttggttcttttttcattgtttgcaaaaagaaattattaataatattatgaattggtattcttatcacttaagacaatattcttaattagaaaaggttaaacatgttagaaaaaataaaaactaatagattttgccaattcatctggccatatttattaatcatcttggctacaaccatagtcatttcaccacagctaatctcacacactattttagctagtgatgacactgctgataccttatttcactatagtcgcttttatgatgcagggatgcagcttaaaagtggaatctttagcattttccaaactaattttacttttcagcagagcggaagaattattaatgccatttatgggccgcttttcgcctattttaacgggattttagttcttattgctggtaattggtttaactatcaagttatcttagcctatctaatttctttattgggtgctgggagtatgtattacctcctaaagcaggtaggtattaataagcttttagctactgtaatgggaattatctatattaacattgggatgattccagcctttatcaatcgtagttcttttaatgggtggggccaggcgttaatgccgctagttgttttatgcggcgttcgcatgatttgcgataaaaaacaaccaattaactggattcagttaatgattgtgatgagtctgcttatccaagtccatgtcttaagtaccttaatggcagtcttgttactgattccattctttatctactctttaattattaacaataattctaaaaaagtttggataccttttattaaggcagttctaggaaccgttgtcttatcagcaaatgtaattggtgcatttttagttttaatgccgacgaatcacctttctgcgactactgaatttgatttgtctcgtggcggattgcgaccacatatgctttggcataacgaatatggaacagcatttgcatatattttgccaatttttgttttattgattattgcgcaatttatctatgttgtcatgcactataaacgagacaggctaaatacttttgtaaccatttgggggactgtcttattaggcttatcttcatttgtttttccatggggactagttcaaagagctttcccaagcttaaaatcctactttcagtttccatttagattaacagttgtggcatatccattgattttactagggatggctttaacggttaactacttactaaaaaagggagttaagccaaaagcagttggcattagctcggtaacaattttacttttagaagcagctgtgccaaatataattaccaaccacattttcacagttgcttgtcaaaaagatgcacaagttcaagttgtcgctaaacaatcaaccagtgacaagatgctagaaatgttgaagtggcattatttaccagactatttaccaacgaaagataagtcgattgaccaaaacgcagcttatctatataaaattaacgttgttgagcgataccaaaaatttgatcaccgagttactaaaaatggtgatttagtattatcttggaaggctaataaagataataagatagttttacctgttgtgctttacacgcaaagtgaactaacagtgaatagtaagaaattctccggtgctaaaaatataattgggaatccaattgttaatcaaaaagctggattaaatcgcgctattttacactttgccgtgccaagctggttctatgtaattagtgcaatttcattaatttcttggcttttagttattgtatttttactatggaaaaaatttataaataataaaaacaattaaaagatatcgaaatcatatataaaagcagttccttaataagttaaatgtattagggaattgctttttgtttgtatggtttatttacgattaatatcaatttatttttcaattaatgcatggctatagttaacttgttatgttattatttaactgtaagaattgaaaccgctttctatggtttcagaggaggaaaaaagttgagtacacaagaacgttattctcatgatgagttaagaaaagctaacaaaaaatttagtcgggttcgttctactattgaatctgccttttatggtaacaatgtacacgaagtaactagtgttgctgaagcttataatttagctaagaaacaatctggtgttatcgaaactgacctaccaattttacatactaaagaactcggtttaccacagggtgcaaagcaattagtttataatcacggtaaaatcttgggtagaacagcaagtgcacgtcactttgttgacgatccaaaagaggatcctgaagcattagctggcaatttacgtgaagatatttataagggccatgatcaaaaattcttaaaagcaacagttttagtaggattagatccaagctttactgttaaagcacatattatgatgccagaagatcaagcctttaacttactttcatatatcttgaacttccatttctttgatgaagaagcagaaaagatctataagaactcgaagttatatgatgaaggagatatttacttctactttgatccaaatacacaagatgaagactatcaaaagggctttggtgtctttgatgctccacataactgtgctgcagtctttggcttacgctacttcggtgaattaaagaagggtactttaactcttgcttgggctatggctcacagaaacggttatactgcttgtcacggtggtgaaaagtcattccactttaaggataaggatgataaagtatttgctttctacggcttatctggttcaggcaaatctactttgactcatgaaatgtatgatggtaaatatgatattactgttttgcacgatgatgcatttattatttctcgtgaagatggatcttcagtagcattagagccttcatattttgataagacgcatgactatccagcaggccaccatgagactaagtactacactacaattatgaactgtgctgttactcaagatgaagatggtaagaaagttattgtgactgaagatcttcgtaacaataatggtcgtgttattaagacacgttatacttcaccacatagagttgactatgaaagtgcaccaatcactgccttattctggattatgaaggatggttccttaccaccaatcttaaaggttgatgatccagttctagcaactacaatgggacttactttagcaaccaagagaactagtgctgaaaacttaccaaagggctttgacatgaatactttggtaattgaaccatttgcggactcattccgtgcttacccagtatctggtgactactcagactttaaggaattatttactaagcgtggagcttcttgttacatcttgaatactgatgcatttatgggtaaggatattccaaaggaagtaactaagaagttagttgaagatcttgctaatggtactatcaaagacagtgactggaagcaatttggtaacttcaagggtgtatcatacttgccaattgaaggctacgaagttcacttagatgaccctgaatatcaaaagactttggctaagagaatgcaagatcggttagactggttgaataagtatgatgaagaacaccctactcaaccaattcaagaagaagctaagaagaccttggaaggtattattaaggaattaaattagttaaacatagttagaaatcctcttaaaaatttttatatttgaacattaaaaaaggcatcccgacagggatgcctttttgttagccattaacttgccttactctttaagttctccttcggcttgaagcttctttttgatatcttcaaatttcttaggagggatgcgagtaatatgttgtcttctttgatttcctagaatcaatggaacacgttcaatgactgtatctgcataatctaagccaaaccatgaagcagggtttgaggaaagattttgaagccatacacgggcttcaactaagaatttttcataacttctaagttgtgtttgtggactaattacatcgttaacgataacgaatgagaagtcaccaacatctctaccaggagtagtagtgtactcttgtggttgagattcaatagttccatctgcaatcaagtcatgaacaatttgacgcaagtaaacattcacactagtttgctgcttgaaaccaaggaagagctgaacgttaatgacattctttgtaccataagtgttaacagcatattcagcagtgaatggctcgttagttacattaactgttacaaaccaatatgcgcgtgctcgcttaggacgtttatctaagatagagtagagaatttctcgcttaataaacttattgtacttaacttttgccatatagactaagttagttgcaaaagtaggataatcttcgtcatgacttaagttcgttaacatatccacgtattcatcaagacgaacataagcgttacgtgattcacgcttgtctctaattttattaccgtagtaccaaacgtacataatgattccgatgaatccggcaataactagtgaaacgtaaccaccgtgcatgaatttactcaagctggctaacataaacattacgtctaaaaagccaaagaaaattaagaagagccaattccaaatggtatgaacacccttcattgccaaccattcatagagcagaattgttgtcattaacattgaaatggtaattgacaaaccataagctgcttccatgtgcgctgaggtttggaagaaaagaacgattgcaatagttgctgcacaaatcattttgttaactgaaggaatataaatctgtccctttttagtggaaggatacataatattcattcttggtaaaaatttcaaaccactggcttcagctactaaagtaaatgaaccagtaatcaaagcttgtgaagcaataacagctgcaatagttgctaaaacaatcgcagctaaacgaatgttttgtggaataatttcgaagaatgggttgaagtcaccatttcccgcattgtagttaggattgtttaaaatccaaacaccttgaccgaagtagttaagtgacaaacaaacaaagacatatggccaggaaccaataatgtttcctttaccaacgtgaccaacgtctgaatacaaagcttcagcaccagtagtagcaaggaagatagaacctaaaataaagattccagctttgttgtaaggactgaataaaagtttaattgcgtagtatggattaagagcttgtaaaattgaaagatcccccatcatattcattaatccaattacacctaagaaggtgaaccagataaacatgattggaccaaaagccttaccgataatacttgtccccattctttgaattgagaacaaaagtaaaagaattactactgtaatcgcaataacagttccttgagtagaaactggaacgttaccatgaccaaattcaattccttttaatccttcaatcgcagttgtaacagtaactgcgggagttaaagtaccatcagctaaaattgctgcaccaccaatcaaagcaggaaggacaagccattttgctcgtttccggaccaaagtatagagggcaaaaataccaccttcaccatggttagtagcttttaaggcaataaagacagtttgcaaagttgttaacagggtaactgtccaaagtactaaggaaatagaacctacaataaagtcgcgatttacgttcgcaattccgccgtttccggcaacaattgatttcataacatatagcggacttgttccgatatctccgtagacaataccaatagcaatcagtaagcctgcggctgatatatttttccgtgttttttcattcattattatattctcccaataaatagccaaatagctaaatattcaataacgtaaaaaagaatgccgaaaagacattctttttttaaacatatctattttcatctatttgcgcaagagttgcaagtatctgcaggcgattaattaaaaatatttatttcaatttagttctttgaattgatttaatattttgtgagcctaggattaatggaactcgttcaactactgtatcagcatattctaatccaaaccaaacagcaggattagaagataaattttgaagccagacacgactttcaactaaccacttttcataagtatttaattgagtttgtggactaatcacatcatttacaattacaaatttaaaatctccaacgtcacgaccgggagtcgtggtgtattcttgtggctgagattcgattgtaccatctttaattagctcgtgaactatttgtcgtagataaacattaactttttgctgttgtttaaaacctaaatatagttgaacgttaatcacgttttttgtgccgtaagtattaattgcatattcggcggtaaagggttcgttagttacattaacagtgacaaaccaatatgcatgggcccgttttggacgtttgtctaaaattgagtagagtatatcgcgcttgataaacttattgtacttaaccttagccatataaactaaatttgtcgcgtataaaggcacactatcatcatgacttaaattacttagcatggaagtgtattcgtctaaacgcacgtaagcatttttagcttcgcgtctatcacgaactttgttaccaaaataccaaatatacataattgcaccgataaaggcagcaataattactgttacataaccgccatgtaaaaacttagctaaactggaaattaaaaacatactttcaattgcaccgaacaaaaacagaaaaactaagcgtaacaagatgttaactttttttagagataggtactcaaaaagtaatattgtcgtcattagcatggtaacagtaattgctaacccgtaagctgcctccatgtgttctgatgtcttaaataaaaagacaattccgattgtagcagcgcaaagcattttattaatagaagggatgaagatctggccttgttcagttgagggatatataattttcattcttggtaaaaattttaagccacttgcttctgaaactaatgtaaaagatccagtaattaaagcctgagaagcgataatggctgctaaggtggctaaaatgatggcgaaaaatttccactgacttggaagagcttcaaagaagggattaaagtcagtattaccagcatggtagttaggattttctaaaatccatactccttgaccaagatagttcaaggctagacaaataaagacgtaaggccaagaagccatgatattgccttttcctacgtggcctacgtctgaataaagcgcttctgcccctgtagttgctaaaaagacagctcctaggattaaaacaccaaccttatttgctgggctaaacaaaattttgactgctaacacagggttgagagcctcaaggagcgacaagtcatgacttaggttcatagcaccagttaaacctaaaaaagtaaaccagataagcataattggcccaaaagtttttccaattatactagttcccattctttggatggaaaataaaaataaaagaatgatgatggtaataataagaacactgttttgattaggaacgggaatatcattgccaaatctcatgtttttaagaccttcaattgctgtcgtgacagtaactgcaggtgtcagtgtgccgtctgcaagcaaggcagctccaccaattaaagcaggaagaactaaccatttggccttttttctaaccaaagcataaagtgaaaaaataccaccctcaccatggttagtcgctttaagagcaattagaacatacttaactgttgttaaaagagttattgtccaaagaataagagagatagatccgactatatattctctgttaacactagcaattcctccattttcattcacaattgccttcataacatagagaggacttgtaccaatatcgccatagacgattccaattgaaactaaaaggccagctagagtgaccttttttcgtacaccattattcatattaaaatttcctaataaaataaaacgtaatgacattttagataaataaaaaagaatgtattaaaacaatacattcttttttactagcactattttgttcctttaggattcaatatgcaactaataatttgtgatttttttatgaaagagtttgtttaatctcgttacgacgatcagtgtaccatttttcccaatcttcgtaagtcttcatgttttgtggatctacgccagtttgtttttggatgttgttaagcatatccataaaacggtctccatgaatatttaaaacatgcttaaccaagttgcgacggctgaaagccatattgttagttaagtatgtattaatttcgataacatcatgattaccatcataaacatccataatttcaagatcgctttcgtcaaattttgaaatgtagaagttagcaaatgtctttaagtaatctggttgttctttaaattcagtagctggcatttctacacgatttgcctctggcataactacttcaaattcttctttttcttgagtttcttcggtgttcttcttgtcttcagtcaaagttaagagctcctttactgtctagctgtacaaaaattcaatataatcttacattgaattacaatcaaaagcaaattttatagggcttatttaaagttttctacatcttgtttggtgtaagaatcaattgtagtatgaccactattagcagctgatctcatgaagttaactactttttgatcagaccatgaactagtatcaacgccaattgaacttagttgattacgggtttgagaaattactctaccagtaactgtttgaccgttaatcatcatactatcattacttgaagttgatgaagaattagtatttgaattgttattattagctgtagtgttgctgcttgagcttgttgcactagatttttgacttgcagcattgttgtcttgagagtttgagctatttgaattacttgaactcttgttagagttagaactagtgttgttagtattactactgtttgatgagctagattttgagttagaactttgcttgtttgaagtagtagcttcatcgtcatcattagcatctaggttttcagtgtcaatgtcatcgttaacattttcgctgtttaattttgcattagcaactttacgtaaatgtttaacgttcttctttaccttcttataatacttactattaatgtaaggtaagtctaaaatttgatcacaagattcgactgctgcttggtagtccccgtctctgtagcttagtttagccttcttgtacaaaggattaatatcattagtgatatgatcttgaaccttgtcgattgtcttgtagagtttagaagcttgcttagtcattactgagtagccattggtcttgttggctgctttatctaattcacctaaggcatctttaaattcatattctctaatttcttcttgagcatccttcatgtcgccagcttgatctgcataagcttttgattcagaagtggattttacatcatgtgcatcttcaaatttttcttcagctgtttcatatttttgactagaagcagcatcttttccttgattcatataggtggtgtacttgtcggaaccactattagatgaattatttgatgatgtgtttgaacatccaactgctaaaaaggtaatgaagaatgccgtaatggcaactccgagttttgatcgtttcatcattttttcctcctataaaaatgaatttatcttacttaaattataccaaattcacgtatgaaaaatttgttgaaaaagtggcacaattttttgagataaatcgttagtaatagtgtaaggcaattcaccggtgctgacttacaaaaattaattatcagtttgactatttagaggtataaaaatggaatttattttaaaggatcaatcagttcaatttacttttgcaggtgaaaaatatagcaatggtaagaaaagtagaattttaaaaaatgttaagaagcaagctagtgctgaagaagtaatgaaggtaggaaatgccttatctaagttgcagaaagatgatggtattaaaactgctagactaatttcatattcagatattcaagcttaagaaaaacacataaataaagaaaaatttaggagaataaaaaatgactactactaaaacattaagacttacatttaaaaacgctaaaaataagaaagtaaatctatctttaccggatgcagcagaaaacttgactgaaaatgaagttaaggatgctatgaacgaaatgtgtgaagctaacttatttgtaaaggaagaagttgatcaatatcaggctcctttatctgctcaatatgttgaacgtacagttacttctgtgtttgatgatagtgaaaagaattaggacgatattttttgagataagaaacttgattaagttattaaataaactcttaaaagggtaatgtttcggcattactctttttattttgagatgaaagtatgtaatttatgttacttttttatttcagaatgtttgttcggttgtatctggcaacttgccaaactataataaagggtgtatgtaaattggagggagtttaagtgatgaaaaaacgaacattcactggtattgctaccgcggcacttataaccactgccggtatatcagttaccaacaaccttaaaccagataatcctttaaaaactggtgaaggtactgttcaagctgcaacctatcaacaagaatttttagataaagctattccagctgctacgactgcatcatctaagtatggtacttatacttcagttatgcttgctcaagcaacagttgaatcagcttggggtcaatcaggtttggctcaagaacctaataataacttatttggtattaaaggctcttacaatggtcagtcagtaaatatgaatactggcgaatacggtaatggtggttactacactactaatgccggatttagaaagtacccatcatatactgaatcatttgaagataatggtgctttattacgtaaccaaatgggtaattattactctggtacttgggtagaaaactcaaataactatgctcaagcaactcaaaatggtttacaaggtaaatacgctactgatccaaattatgctaagacgcttaatagtgtgattgcaactaatggttttgacaaatatgatcccgttacacaagttgttaacgaaaatcgtacagttgcacaaacaacaccagttatgagtgcaccagttgatcctagtgttggtacacaagtagatactgcaagagttggtcaaaacgtaaatgttactaagtatattacttataacaacggtgtaaaacgtgcatttattggtaatggctggattaatgcacttgcatttagcccaattactaataacactactgctaacaatgccactgctaatactaataatagtaataagcaaactacaactactaacaaccaagctagccaaccagttaagactccagtagctcaaactcaacagtctcagactcaagctcctgcagctccagttaaagcagccactgttgaaacaaagaaagttgcagaagttaaaactccagcccaaactacgactttgaatgttaaagctgaaactaagtcagctcagccagttaaacaattagctacttcattagcagcaactccagctaagaaagaagaagttaaaaaagaggctgttaaggctgaaccagctaagactacgcctgtaaaagttgaagctcctaaagctgaaaataaagaaactaactctgcaccagtagttaaagctcctgaagttaagactactaatacagttaaaaatactgaaactgtaaagaaagaaaccactccaattgttaaggtagctgaagttaagaaagctgaagccccagtagtaaaaccagttaaaactgtaaagaaggaaaccactccagttgttaaggtggctgaagttaagaaagctgaagccccagtagtaaaaccagttgaaactgtgaaaaaagaaacaactccagctgttaagaccactccagtagtttcaactaaagaatcagctaaagtagttgaaactccagtagtcaagcctaagaaggttgaagttaaggaagttaagaatactccagtaaccactagtgctaaaactgttgtaaaaccaactgcttcagttgttgaaaatgttgcaccagtacaaagttaccagagtgctgtatcgactgcagctgcaaataatagctatggtactcaatggattagtactaatactgctccaaaggctgcttctactgttttggttaaagtaactaagactacccaagttttatcagctccaaatggtcaaaaattaaaccaacaagttgaagctggtagtgcatttgtagttatagcttcaaaatatgctaacggaaatttatattatgaaattagtaatggtaaatggattatggcaaaatatactactcaagaagcacaaattactgcaaaatctggtgtattaactattaattctaaaccagactatggtgtagcagtatggcgtgttccaggccaagatcaaatttcaggtaagttcttaaaagatggttcaagttggagatacttccgtgtagctaatgttaacggacaaacttggtacgaccttggtggaaatcaatggatatctgccaagtcagtactagttcgttaatttataaaagattagattgtttcattaaaattttttggaggagaaagttttttaatgcgttcaacaaataagaaatttattagtgcattagcttgtgctagtgctatgacagctttagcaattgtagatcctatgggagttactaaaactcatcaagtagcacaagctgcaactgatactgtacctgcaaagtctacaggtgtagatgtttcaagttggcaaggtaccaagttggatcaacaagccaaatctggtgcacaatttgctgtcgttaaagtatctgaaggtactaactaccaaaaccctaatgctcaaggccaaatccagagtgctgaacaaaataatatgatgactatgggttaccactacactcattttggctctaacagcaatcaagcagttcaagaaggaaactatgcagttaattcagcacaacaagctggtttaccacaaggttcatacttagcaactgattgggaacaagacgttaataataatactaacggtagtgttgcagctaatactaatgcaatcactagcttcatggatactgttcatgatggtggatacaacccaatgctttattctagtgaatggttactaaagaataaggttgatactaataagatttctgaaaagtatccaaatgcattatgggtagctaagtacaaaactaatggtcgtgaagataatcctgactacaattacttcccatcaatggacaatgtagctatttggcaatatacgcaaaattggcgtggccaaaatgttgacggaaatgttaatgtagttcctctttcaaataagactactgctgataataacaacacctcaactaacgctgctaataccaataattccaatgctaataacggtcaaagcagtagtcaagcacctgcaaatccaattattaacaatagtaatgctactgctaagccaaataataataacagtacacaaccagcacaaccaactgaaactaagccagcagaaaagccaagtacaaccactaacataaacagtgactggactaagcaaaacggtgtctttgtaactggcggagcaattaacttgagaactggtgcaagcactgatagcaaggtcattattcaattaccagcaaactcagaagttaaatacgatgcttatcgtacaattggtcaatacacatggttaagacaaccacgtgcaaacaacgaatacggctacttagtaggacgtgataatggtcaagcatggggaacattcaaagaaggttcagcaaccactgctaagccagccgaaactaaacctgctaataaaccagcacaaccaactaacaagccaagtacaaccactaacgtaaacagtgattggactaagcaaaatggtgtctttgtaactggcggcgcaattaacttgagaacaggtgcaagcactaacagtaaagtaattgcaatgctcccaacaaacacagaaatcaagtacgatgcctaccgtaccgaaggtcaatacacatggttaagacaaccacgtgcaaatggtcaatatggttacttagtaggacgtgacaatggtcaagcatgggggaacattcaaagaaggttctgcctcagtaagtaagccagccgaaactaagcctgctaataaaccagcacaaccagcagaaaagccaagtacaagcactaatgtaaacagtgattggactaagcagaacggtgtctttgtaacaggtggagcaattaacttgagaactggcgcaagcactaacagtaaagtaattgcaatgcttccaacaaacactgaagttaagtacgatgcttaccgtactgaaggtcaatacacatggttgagacaaccacgtgcaaacggtcaatatggttacttagtaggacgtaataatggtcaagcatggggaacattcaaagaaggttctgctaaagctactaatgcagtagctaataagcctgttcaacaaactactcctaagcaagtaaatactaataacaatgctagttggactaagcaaaatggtactttcattaccggtggagcaattaacttaagaactggtgcaagtactactagcccaattattgaaactttaccaattaatactgtaattaaatacgatgcatactaccgttctggtaactatgtatggttaagacaaccacgtgcaaatggtcaatacggttatttagttggtcgtttgaataaccaagcatggggaacttacagataatttgataacaattttcaaatagactaaatacatgaaagacgtgatcctaatgggaatcatgtcttttttgtcttataataaactatgaaaaaagcatggaggatataattttgatttatacagtaaccttagatcctagtgaaagtgtagtaggtaaaggaattaatatttcacttattttaaaaaaactaggtattgattcaattgcgactggaattgtaaatcacaaaaatgtagagcaagtagcagaagagcttgataaagctgagattgagaaccaatttattgagcaaactcgtggaattaaaattactgctaaaaaccaacaaaaattattggattatttgaaagtcttaaaagctggtgacattttagtaattgccggaagctttgctaagggaatagacccagtttatctaactgatttggctaaagttgctgatcaaagagcagctgcattagtagtagatgttccttatgaaaacgtacttgatatcttaccaatgaacccattattaattaagccaaatgagactgaattgaagcattggttcgaaaaggatgacaaggaagtaactacaaaagaattaattgatatggctcatagcttagtagtcaaaggagcacaacatgttcttttgtccttaggtgcaaatggtgctgcaattgttaatatgatggatgctttaatggcacatgcgcctgaaattgaagaagttgatagtagtggtagtggggatgccttacttggaactttcttagctgggatgcttaaaggatacactcctgttagaaatttagctgatgcaattgctgcaggtagtgatacggctcaaagtaaatggcttactgatttcagaacaacccccgcacttcaaaagcaagttattgctagaagaattacctttgaagaagcagaataaatagaataagttggcttataaaagccgacttattttttgttgttttttagtataatggtactaaatttactataaggggaagaaaagtggatctatctatatttattgttagtttagcagctttagtaattccaatcgttatggcgcgatttaggattaatgctataccaacggcagttgctgagattgtgactggaataattctaggaaaaagcttattagataccataaaaatcacaagcagcgtatcgcttctatcaaatttaggtgtgattttgctgatgtttctatcaggtatggaaattaattttgatctttttaaaaagaaggatttacctgagtctaaacagagtaaaattaatccagcacgaatagcagttattgcttttactgctatcacaataacggcatttgctttagcctatattctaaaattaataggcctatttaatgatgttatgctggctatgattatttttatgactgtagccttaggagtggtaattgccactctaaaagaaaaagaaatcttatctcgaccgattgggcaaaccatattattaacagccgttctaggggaagtaattcccttattgctgttgactatttatgcttcaattaacggtgggaatgctggaagattatggcttattgttctgcttttcctagcagcaattatcttgttgagacgatttaaacaaccgtatcggtggtttaataagatctctaaagcaactactcaactagatattcgattggccttcttcttaatatttaccctagtaacagttgcagaacgtgtaggggcagaaaatattttaggtgcctttttagctgggatggttatgaagttacttgaaccaagtgaagccacaatggataagctaacttctattggttatgggttcttcattccaattttctttattacaacgggtgttaagctagatttaaagtcacttcttgctaatccgaatgctttaatgttgatcccagttttagtattattcttacttttagccaaattgcctatatttttggtttatacacgaaatttcaataaacgtaacagtcttgcgggtacatttttaattatgactacaattacaattgtacttccaacattagaggttgctcgtaagttaaatgcaattactgaaactcaatcagatgcctttattttggcagccgtagtcgtatgtatcttaggcccaattttatttaattcgctctttagattaactaaagaagataaaattaagcaacgagttgtcatgatgggaaccaatgtaatgacggtgcctgttgctcaggagcttcatgataattggtatgatgtattattagtaacccataaaaaagaaaactatgatacttataagagcaaggttgctaatttgaagttaattaacagcttagaagagtcatgtttagaaaaggccggtgtctttgactgtgatattttagtagctggatttattgaagatgacctaaatcgtaaaattgcccgtttagcaaaagagcatggtgttcaaagagttattgctagtcaagagagaccaaagcctgaaacaattaagaaattagtcagtgaaaaaattgaaatttacaatattttcaatgttcagacttctgtattaagagctctaattgaatcaccttcaattttgagaattttaacagatactaagaatggcttgtttgaagtaacggttagaaatcataagtatgctggtcagaaattgatgaatctagactttattgaacaaatgactgttagtcgaatctggcgaaatggtaaatggctagtgccacatggaaatacaatcattgaagtaggagatcatctaatttttacagctaaaggtgaagatgcagaaagaattagagaagaactaggtagaagaaattaaatataaaaaaatgacaggatttttagtcctgtcattttttgttaacgttgatttttcgcttcttgtaaaacagctagggtatttagactatgggtaaaagcttgatcagcagctgtaaaatcatgttgatcaataatcttagtgaattcgataaattcagcaatcattcgatgagaatacttgttgtggttaacaactttcggctcttctcctagtaattggatgccaacttttggcatttcattaggatggccgtaaataatgagtgcacctttttcaccttcaatggtactgacattaggtgaaaagctatctttagctgcaattgaactggcttgtttgtcagaatagcccaagtgaaggatgccagaagtatcaatatttttttgaatagttgggaaatatttaacagaatctggcttaccaaataatttaataataatgtgtaagttgtagatgcctaaatccattagagccccaccatcttttttaggatcgaaagctggttgaatgtccccttctaagaaagcatcatagcgacttgaatattgagtgtaattaagattaacaacatgaattggggcaattttagctaagttatcttcaatgaatttaaagttttctaaataaatgttagtgatcgcctcaacaataattacttggtttttatcagcaatttcttttaattcacgtgcttcatcagttgtagcaacaaatggtttttcacaaatgacgttttttcctgcttctaatgcggccttggcaatactaaaatgcaaactatttggaacagctacatagacagtatcgatattagcatcattaaataggtcagtattgttatcgtataattttgaaatattatacttttcttgcaattcaagaccaatttgatggctttttttagtagttgaaagagccgcaagttcaagatctgggatttgatcagcaattgatagaaaatcatgaacaatttttcctgagccaataatacctaatttcataaggtaatctcctttaattaagtttaaaatttaattttttagcatttttagtaactgaggaaggtacggttaactttttaactttattaatgtcataaagatgtaaggtgagcgtaccttctttcttagtattataagtaactttatagtacatatcagttagttgttcttttcgattagtagaaattcttaaatcaatatttttaacattagttgactgtggatcgctagtgggagcgacagtagttgctttttgcatgcttttaattacatcgctattatcacccttataagaaataatatagccattgaatccgttagatttaatggtcatatgtttaaaggcatcgtcagaaaattgggtgaaatcatgtgcggtataaagctttttatagcctgaataaacttcactaaagatggcattttgtttaatgtaattccattgtttggtgccatcacggtggtaaacatagtctttgttaccccataactcagaattagtatcagacttagggatgcttttcatggtaatatggatggcattatctggaccgacgacataatttgaatacatttttgactttgcattggtagttttgacattaacgcgtgcagtagcaatttgggtattggcagccgtagttaatgcatctttaacgcttggcttattaaatgcaataattgcgccccaaactactacgattaggataataatacctaaaattaaagcggcaattttgccgccttgattgttagaaaaaataatctttttatctttgattttatttttttccatcagtgtatctttctaaatgattattgattattttgttcttcttgtgctttcttgatgtcttcagcactaattgcattcttttgaatgtcagaaggaacggctaaatcactgtgttgacctaattggtcgtaagttaggttccaagtgaagttatattttccgccagcagtatattgggccttaaaggtcattgattcgacatttttggtagttggatcaattaaataagtgatcttaagattttgaacttgagctgattttactaagcgggctacctgcatattttgagaaccaggagtgttcatggcatcgataattaaaggattgactgcattccatagattagcgtcggtaccatcaaaactaatttcataatttccattttttctttgaacagtggctttttgagctaaagatttgttaattttattaaaagttgcaggatcgaatctttcctttacttggtctgaatcaaagctatctgcatcaattgagtttttaatccaatggcccttgttttgctctaaaagtaagtacatatccttcttggtaagccacatttgttcagtttgagatttcttcttttgagttaaggtataggtaaggttagttacatcacctttgtctttgaataaaccttctgattttgacttttggttcatttcattagaattagtagtttgagtgaagtgaccgttagcaaagctagaattaaattttgcattgattaatgaacttgcagaaggtccagtactctttgcttgtttactgcttttatttgaacaagctgtagttaaagaaactaaaattactcccaataaaattaggaagctgaattttttcttcataaaaatatattcccccaataaatgtatctatcttattttattttactctatttttgactgaaaaaagtattctaagagcttaactttagtgctttttaaggacatttaaaatattgcgcaatttactgcctttaacttgtaagttacttactgcttgggttacttcaatgcagccaatatatttaccatgttcattgtgaagactatagaaggaaatgttaattggttgtttatttttggtaatcatgattgaaatgtttttacgcttgccggcgtgcatttgatctaggacttccttaacatgcttttgactgtggccgggatgcacttcaaaaacagtcttacctatgtctttttcagtacgcttaaataggcgattctcattcatagaggaccagacaacacggtcgttttcatctaaaacgtccatttcttgtggaattgttctaaaaattgcatttagctgttcaagtgagagatgcccaccatctaacttgatattttccataattaaatacttccaattcatcaaaattaatatatctatcgttattttaacattaaatattttgtgaattaatcaagcttttttccgtaattcctatgaaaattttgaataagcgtgtaaaatagttagtgaaacattgaattttaaaggagatacagttcatgtcgaaattagttttaattcgtcacggtcaaagtgaatggaacctttctaaccaatttactggttgggttgatgtaaacctttcagaaaaaggtgttgaagaagctaagaaggctggtcgtttaattaaggaacacggtcttgaatttgatcaagcttacacttcattattaactcgtgctatcaagactttgcactacgcacttgaagaaagtgaccaactttggattcctgaaactaagacttggagattaaacgaacgtcattacggtgctcttcaaggtttaaacaagaaggatactgctgaaaagtacggtgacgaacaagttcacatttggcgtcgttcatacgatgttttgccaccagctattgatgacgataacgaatacagtcaagcacatgaccgtcgttacgcaaatcttgatccacatatcgttcctaaggcagaaaacttacacgttactttagatcgtgtaatgccattctgggaagatcacattgctccagatttacttgacggcaagaacgttattattgctgcacacggtaactcacttcgtgctttaactaagtacattgaaaacatctctgatgatgacatcatggacttagaaatgaagactggtgaaccagttgtttacacatttgacgacaagttagatgttgttaacaaagaaaagcttgacgactaatttttagttcttgagtaaaagaagctccgacgaaagtcggagcttttttgttgagagggataatcatgagagaaagaattgtaacatacccagcaatctttaaaccaattgaagataatgtttactttattagttttcccgatgttaagggagctattactgaagggcatggactaaaagatgcttttgaaatggcagcagatgcttggggaacaattttgtttgatgaaaagaaattgccaaaaatgactgatcccgctgagattaaaatagaggatcctggcacttttgtcacattagtatcgactgatctaactaagtcagtagctagctttgaaaaaatataactatacctgctaagctggtcctccaagctgagaaaaagaaaattaatttttccaaagtattaacagaagtacttaggaaaaaattgaactatcaataattaccaggcaaagctaaaatatattaatggtgacattcccttaaaaatcttatataattgtaaaagaaaaggagatagagagtgcgagtctctacctccaatcgtaacttaagatgactgagtgtgtggctaatccttgtgattagccttttttgttattgcataagcaattgctgcacggattaggaaaatacccaatgcgtttaagacaatgccgatagcaatagcagctattatcaaggcacaccaacactccagcctatccaaattatcatggcttccacctccgtaacctaaaatatatgtgaggggtgtagagccatgaaaagttactaagctcttatattagctatctataaaagcctagtaaaaattatatcaaaatatgaattgagaatttgtagtattaaacacaaaaaaaagacattccatcaggaatgtctaaagtgtgactatatgtttaaattttgatttaactaagaactagttttataattttaccaactagctttgcgcacaccaggaagttgtcccttgtgtgctaattctttaaagcgtaaacgtgacataccaaacttacgcatataaccatgtggtctaccatcatgtaaatcacggttatggtagtgagttgggtgagcatcaagcggtaattttgctaatgcttctacgtcaccagcttcttttaattcatagtatttcttgattaattcacgctgcttagcagccttaacgattttggatttttttgccatatatctttcctttcgaatatagagtataaaaaatagtttaattaagaagaaaaaaggactaatttgagctaacttaaagtaagtatattgtattaaattattaataatttgtcaaaaagaaagtattttaaaaagaattagtttaaaataagtaatgattgattaaagaagggaaaataagccgtgggtatttttaaaagaatacttcataatgaagacttgcgacagctaataatttatgtattaattggtgtgttaggattaggtgttgactttggaatttttgccattctaactcactttaagatgcaagtcgaagtagctaattttatttcatcatcttgtgggttgatcaacaactttttctggaatagttttcttaactttaaggttcacgataaattattagtaagatttatttcctattatttagtaggacaaattacaactttgtttacaactgtctgcctatttatttttgtaactcaacttggctataatcaattgattgtaaaggctgtttctacatttatcgctaccttgatccaatttgtaattaataagttacttacctttagaaaaattaaaactactaaaccaaaagtagacgttagaaagtaataagaaagactgttaaagtatgaaaaaattatcaattatagttccttgttataatgaagaggaatctgtaccacttttttatcccgcagtgaataaagtaatggatactattcctgatctagaaccagaatattggtttattaacgatggatcgaaggataataccctaaaagaaattaaagaactacgcaagaaggatccagagcatgtacactttgtttcattttcaagaaactttggtaaggaatccgctctttacgctggacttcaagcggcaactggagattatgtggttgtaatggatgttgacttacaagatcctcctaagttcttaccacaaatgtatgatctaattaaaacgggagaatacgactgtattggaacccgtagagtggatcgtaccggagaagctaaatttaagtccttcttaagcgatatgttttataaggtggttaataagatctctgatactgaaatcgtaccaggagctcgtgattatcgaatgatgactcgtcaaatggtagacgcagttttgaatatgcctgaatacaaccgtttttcaaaggggattttctcttgggttggatttaagaccaaatacttagactatcacaatgttgaacgtgttgctggtgaaagtgactggaacacttggaagttattcaaatatgccatggatgggattgccgacttttctcaggctccgcttaacttggctgtctggattggtacaggatcgtttatcttatcacttattggattgatagcagtgattatccgtcgtgtgctttacccagattcaagcatttttggttgggcttcaatggtatgcattatattgcttcttggtggtctacaacttctctgcattggtattttaggtaaatatattggtagggtatatattcaagttaagaatcgaccaatttatattattaaagagaaaaaataaacgtaataaaagaccgaagttcacgtggagcttcggtcttttttgataacaaaagttagtattctttaagttagacttgtttatgattgtacttcttccaaaaaaatccctcctgtatttaatttctaaaaaagcgtcgctgatcatactaacagaaaaaattttttctcgtaagtaatttttttggagattctaaatttgaaaagtgcgataatttgaacaagggagaatttacgaatgaaaaaattaacaaaagatatctggataaagattgctctatctcttctaggagttttggctgctattttggtctatgtacctaactatgctctagttgatcaagggctcaaaggtagatgtgctatcttttttattattgcgatagttttactttggctaccaatggagctaaagagcagtatttttgcacttaatttttactatgaattaggtttgattttgattattgtctttttcatgactaatcaaatggcaatgaattttactattggtctagtgattgctttgcttttactaacttggattggaatggtaatttttaaaaataatttagtcatgaagcaaaaaaatagtgagcttttaatcattagacttgtcatgatgctggttttagcatatttagcctatatcagcggttttgcagctcttatgggagctgagatctttacagtacaaggacaaacttggctacttattttgggttttgttctgtgtgtatattatctcgtcttagcaggaagtatttggcaaccatggtttagaagatggacttcttggatcatgattttagtagcagttgttttgcatatgttatttgcaagtgccacctctttaaatattatctttttgcctttaattggagaggttattttacttattctagcttggcggagtaacagaattttaatgaaaaagaaaaggatttcataattagctcttgtcagactgtatcgatccttgatagaattaattgtttaaaaatttaggagagatacaaaattatgaaatatgtttatttgtttttaccagcaatcggctggggacttatgcccttagttattgcaagtgtaaagaatagtacagtttataatcaaatcgttggtactgttgctgcttcatttatttttggcgcaattgtaatggcaatcatgcatccagcaatgagctggtcactcttcttgctttctgcattaggaggagcttgctgggtgattggtcaagttggtcaatatatttcctatgaaaaaattggtgtttctgaaactatgccaatttctaccgggttacaattaatcggggttcctcttgttggtgtgcttgcttttggtgagtggagcagtcctcaagctaagctatacggttttattggaatcttagttttgattattggggttgttttaacttcatttactgaccgtggaacaagcgaaggaaacaagtctaatcaagtaagtactattatcttgcttgttttaacttcacttggatatattacttcaagttctattccaaaggccttacatggaaacagcgtttctattttctttggtcaaacttttggtatgttagtagctgtatttatttatacattggttactaagaatttacatgtttggaaagaaaaatctacagttcaaagtggtggggcaggtattctttatgcaattgccgcattagcttacattctttctgttcaagataacggagttaacatggctttcgttatttctcaactttgtgtagtgatttctactttaggtggcttgattttcttacacgaaaagaaaactcgcaaaggcttgatctttaccattgcaggcctaattttaattattggcggtgcaatgttaactacattattctaaagaatgaaaaaaggcatcccacgtctgggatgccttctttgtatcaacttgtcctaattcttaaatcatttttagtattagaacacatttaattgtattagaactaaattaaaagtcaagttaaatacatagagctttttaacaaataaaaaagtatttagagttaaataacaagtaaagaaatatagaattcaataataaattatatgttatcgcttacagttgacatattgagtatagcgtgatattttcaaaatgggattggtcgaaattgtttaggaggacaatggatgctagcaattgaaaacaaccagttaaaggttgaaattaatgaggtcggcgctcaacttactcatgtagttgataagactacgaatgccgactatatctggaatgggagtgaatgggaaagacatgctccgattctttttccggcaatcggaaaatcgaatgacaataaatatattttaaatggaaaaatatatgaaatgaagcaacatggctttgcacgtgattatccttggacagttgtggacaagggggatgatagagtaagtttaactttaactgaaaatgaagaaactttaactgtttatccctttcactttagtctaatggttacttacacgttagaggctaaccaattaaaggtagagtttttagttaaaaataattcagaagaaacgatgtcttttggtcttggattccatccaggatttaatgttccgatcgctggagatgaattggaattttctgattatgaagtttcattaagtccagaagttacagaattaactcaattccaaattgatcctattccatttagaaatggtaaagttattccagtacctaaggcagaaaagagtacattacctttatcatattcagaatttgataatgggttgattattattaacaatcctggattaactggaattgtattatcgagtgcaaaatctgaccatcagatttctttaactttagaagattttccatatgtggcactttggacaatgacagatccagaagccaaattcttatgtatggagccttttgctggactacctgatgttaaaagtgacgaattaactgattggatgaaaaaagagggaaataacttcttagagccagatgaaagcacacatttttcaacgacaattactttaaaataatatagaaagagggaagcaataagttttcctctttttttactaattagttaagatttgtcataattaagttttaagaatgtaattttgctataatatccttgttttaagaaagtttgagaaagaatattatggataataagccccaagaacctattcactcaagagttgagttgaatagagaaaaacataataagaaaaaaaaggtccacattattattgggatagttttatttttgtttttaggacttggaatttatgcaagttccgtttatttaaaagcaaaaaatgcttttgataaaacttatgatcctaaaacggccgtcaagcaggatagcttttctggtaaagaaccttttaatattctgttgttagggacagatacaggagctttcggcagaaaagaagttcgtggaaactcggataccatgattttagtgaccgtgaatccggccaaaaagaaactttctttaatgtctattccgcgtgatacgatggcccggatgattggtacggacaattttagtgtgcataaaattaatgcggcttataatattggcggagcaaagatggcaatgcggaccacaagtaaagttctcaatgtgccaataaagtactatatttcgatgaatatgggcggcatgcggaagattgttgatggtgttggtggcgttacggtgacgccaccattgacctttacttatgatggctatacctttactaaaggaaaaacagttcacttaaatggtagtcaagctttagcttactctagaatgcgctatgatgatcctaagggagattacggtcgtcaattgagacagcgtgaggtcattatgtccgttttagagcacgcactatcctttaatactctcaaaaatttagattcaattttaggttcagtgtctactagcctgaggacaaacttaacttttgattcaatggttaagattagtaaaaactatcgtaaatgtactaataatatgtctagtgactacttacatggagtaggcgcaatgattggagacgcttcgtaccaagtaatgtctgatagagaattacaaagaacttcaaatattgtgagaaatgatcttgggttagattcgatggatattgataataatgaaacctatcaaaattcaatgaattctcaatttgattggaacagtggtgactctaatcaggtatactacatatatgatccgtatacggatgaattatggaatggagatagggcgtactaatggatgaatttgtctcgctagtaataggatatttcctcggaaatatcctttttgctatgattgttacaaaaatatttttgcataaagatccgactaaatacggttctggtaatccaggaacggctaatgtcggagcagtttttggtaaaaaatggggtattctgacttgcattggtgatttagccaaaactttagctgctttgttaattgtttactttatttatcatggtaatcgtctagatttgtcttttgcaggtcttggagtggttttaggacattctttcccattttggaatcattttaagggtggtaaaggagtagcagtcactgctttgtggattgtcttttttgattggagagcgggcttaattgctttattaattggcctatttttagtcattattatgaagaaccttactataccaccgttggtctatatgttaggattcagcatttttacttggattaattttggctgggaacaagggttaatctttttaattgctaccttaatcatgatttttcaatttagaaaagatattgtcgatttctttactggtaagggtaagcgtgtggatgtattagtcacaattaagaaaaagttagggatatacaaatgaaatcagtattgaaaaagacaatccagtggattttacttatagttttactgctgggaatattaattcaaaccttaggcttttggaattataatccgccaaccgttgctggccgaactaaaattggtttaatgattggtttagtagagctagctgtgatggtttggtatgggatgagctacggcaataaggaatacagttttaaggaatcagttaaaagttggcttgaaggagtaattactttagtcatcttttatcttgttttcgttatttctttaccgcaatttttctcagcttggaacttatggggaatcttctttcccgttttaacaagtacatcagccttatttagtgggattattatttctttattctttcaaccttttatttttaggctgcaaaataagttaagtactaagcaaaatgttttgttattaactacaattacaattttgatctttaccttaagtgcaggtaattcgcttttaactagctatagtatttttggtctctatttggtattgccttttgcttggggaatgcttatttcaaaaattactgtatctaaaaagttaatagctggtttaacagtggcaacagtaatcttacttcccgcagtttattatttcactattcaattaataccaattcaaactccacaagccgttgtcttcacccagatgaatatggcatggaatacgagcttgttaatgagtccatcatcgccagtaatgatcttatttgtcgtaactggcggattgctttttagaaaatggttggtagatgtatcacatagtgcattatctcttttaattcctgcaattatctttgggacaactgcttacggaatgactttatggaaggaaaagcttcaattattactggctcctgttagtaaaaaagtcacttttctcttaattttgtccttattgattgcaagttttattattaattttatttttaatagatttgttctttcaaacaagcatgtgcaaaactttctgaataaatttactggcacagatttaaatgatcttcttaatctattaaacagcggcttgaatttccttaagaagcataggccaataatatgtctctttgcatattttatggttgtaagtattattggtttctttacatttaagagtaatgttaacgttacgttgacttatatttttactaatagacttggcactgtcatcttgtccagtatttttcttctagcgtgttttgaagtcttttatgtacttaccaagcgcttctgggtagcaacaagtattccgactattttagggctaggaattgcgattgctaacggcattaaaatgagcttgagagaagagcccgtttatccaaccgaaattggtgaaattgttaattggaagaccttaattccaatgatggggacaaacaatttgatttatattttaattggattagctgccctaatcgttttaattgtctttttagaaaagaagtttccaattaacctcaagcgtaaaaaatcaagttgggtaaaattggttattagcctcttagttttaattacacctttgtggtttaacgatgaaaattcaccgatctattatatttcaaaaggttttgataatagtcctaactttagaaatccaccagatagtacaggtgctaacggttcaattctgacttttctagactttattaaagtaccaattatggataaaccaactaattattcagaaagctctataaaaaaagttgttgaaaaatatcagaatgaagcagtaagtattaataagacgagaaagaataaattaagcgatcaaacacttgtctttaatcttagcgaaagttttgttgatccaaaagaattcccaagtgttaagatttctaatgatgttcgagatccaattaaatatattcgaaagttgatgacaaccactacttctggccacatgcttagtgctggttatggtggcggaactggaaatatggaatatgaatccttaactggatttaacatgggagtattttctactgcaatcacgccatacacgcaagtgacatctcgttacaagttttatccaacaattgggatggactttaagtacagcagtgccttacatccattcaatggtacattctacggccgaattgataattatcgtcgttttaaatttaataaattcgcgtacttaggctcgaagtataagatttatgataaaaagactatcggaactaatccatatttatctgatgagacagcttatcaaaatggcttacgacaaattaatagtcaaaaagatggtcagtttatcaatttaatttcaatgcaaaaccacattccatatggtgattattactctccaaatgaatataaagaaaatgttagtggatctctaatttctgatgaaaatactaaaaatagttttgctgcctacactaaaggtattgaatacacagataaggctgtgaaaaagtttattaaacagattgataaaatcaacaagccaattacccttgtattctatggtgaccactacccagcaattattgatcagacacaattaaacaagtatccggtaaaattacatgcaacgaactactttatctattcaaataagtatgcccgtgagcatggtgctaagagtaaaatcaagccaaataaatatgtctcaacagcttcctttattccaatggctttagagcaaactaattcaaaagtaacagcttatcaagcgttgcttactaagatttatcaagaattacctgctgtcactattaactattctggagatgatggctttgaattaatcgatcaaaatggtaagcaagtttctgagaagaaattaactaagaaacaaaaagagttactaaaggattatcaattaattcaatatgatatgtctgcagggaaaggatacagcttaaagcttaagggcttttataaataagcagttgactaaatagacattctcccttatgatcataggtaataatagtagcaacttaattcagtgttcagagaactagcggttggtgtgagctaggcaggttaagtgagcgaagtacatggtggggtagtttccgtatcaactatatttaaggcgcattaggcgtaaacgtgggtggtaccacggctaataaagtaatttagtcgtccctagatttcgaaagaagtctagggacgtttttgttaggagaaaattttatggcaaaatttgatattttagaagatttaaaatggcgtggagctattaatcaagaaactgatgaagaaggcttgcgtaagtacttagcagaacatgacgatttggctctttactgtggaactgacccaactggagattcacttcacattggtcaccttattccattcatgattttgaagagattccaaatggcaggttatcacccagtaattttaattggtgggggaactggtgcaattggagacccatccggtcgaaagactgaacgtactcttcaaacagctgagcaagttaagcacaacgaagaaaagttaactgctcaaatgaagaagttatttggaactgaaaactttgaaattcgcaacaatgcggaatggcttggtaagatgaatttgcttgatttcttgcgtgactacggtaagttcttccaagttaacaacatgattaataaggatgttgttgctagtcgtctcgaaaacggaatttcatttactgaattttcttaccaaattttgcaagctattgatttctatcatttgaataaagataatggcgttcaaatgcaaattggtggtagtgaccaatggggtaacattactgccggaattgacttgattcacaagcttgacggttcagatcgtccagcatttggtttaactattccattaatgcttaaggctgatggtaccaagtttggtaagtctgctggtggagctgtgtggcttgatcctgaaaagacgagtccttacgaattctaccaattctggattaatcaagatgaccgcgatgtagttaaataccttaaatactttactttccttagtcgtgaagaaattgaagatttggctgaaaagactgaaaaagaaccttggaaacgtgctgctcaaaagagattagcagaagaagttaccaagtttgttcatggtgaagaaggattgaaagaagctcaaataattactgaagcattattctcaggtaatgttaagagtctgtcagttcctcaaattgaacaagctttgaagaatgctccaagtgctgaagcaacccatgaagctaagaatatcgtagaatttttggttgaaactaagattgaaccttctaagcgccaagcacgtgaagacgttaagaatggtgcgatttacgtaaacggcgaacgtcaagatgatattgactttatcatcgaaccagatagtgattttgatggaaaatatgtaattatccgtaagggtaagagaaagtatactctagttaaaattaaataataaataaaaattaaggactaggaatgtaaaaacgttcctggtcctttttgctataattaaattgatatctgccgttttagctcaggaggtagagcaccgccgtggtaaggaggaggtccccagttcaaatctgggaaacggcttagtgaataatttagtaacaaaaaaattctagggatggtcaaaaaggcgatccctttttataattgttataaatagtataaataatttatgaaagaagaattaatatgactcatgaacttacgctagatgaaattgcaaaatttcaacaagattatcaacaaaataagcaaaataaaattgctgaattggctgttgtgaataacggtgtgcaaaaagcaagtttcaacggtgagggtatccgtgatttaaatcgaactttctcaattgaaattccaactgataatgtgaccgaccaaaagcaatcaggtcgttgttggttgtttgcggctttgaatgttttacgtcataagtttgccaagcaatatcatacaaagaactttactttttcacaaagctatcttttcttctgggatcgaattgaaagagcaaatattttctttaatcatattctagaaactgcggataaacctgtggatgatcgtactgtacatttttacttacaagcacctgataccgatggtggacaatggcacatggctatttcattaattagaaaatatggcttggtaccaacttatgcacaagacgaaagttttacagctaataatacggcggcttttaatcaagcattgaatatgaaattacgtgaagatggattagttttacgcaaacttgctcaagccggtaaaaatgatgaaattgaacaaaaacgtcaagaatatttaagtgaaatttaccgtatggctgtaattgcttttggacaacctgtgcaaaagtttgatctagaatttaaagatgacgatggaaattacaagttagaccaaaatattaccccattagactttttccacaattattttgaagatgacttagatgattacgtagtactttttaatgctccagatcatgagtatgataagctttacgcttttccatttgaagataatgttgaaggcggtagcccagttagatttttgaatacaaagattgaaaatcttaaggaagccgcaattaaacagctaaaagatggggaaacaatctggtttggttgtgatgtaggcaagcaaagtgatcgtcaaaagggaattctagctgctaatttatatgaaactgatacgatttttggtattgaaactaagttaaataaaaaagaacgtcttcaaactggtgctagtggttcaactcatgcaatgacctttgtgggtgtggatgtagttgatggtaaacctcgtcagtggaaagtagaaaattcctggggaacaaaagttggcgataaaggctactttgtcatggatgatgaatggtttgatgaatacttatttaaagttgtagttaagaagcaatacctaccagagaaactagtgaaaatcgctgagggcgaagcaactcctgttccttgctgggattcaatggcttagtctaggggatcgacaatgaacatcgaattagttaaacaatttactaaagatcatctaaaaggtgaaaaaacaggacatgattactaccatggacaaagagtggcaaatttagccacaaaaatgtatctaagtgattatccagatgcacataaagacagcagaatagtagctattattcagacaggaagttatttacatgatacaatcgatgaaaaaatttgtgacaatcctgatgaagttatagacgaaatcaaagaattattgcctaagggtggctttacttctttagaaatagaagatattttatttactattcagcatatgtctttttcagctaatattgagcatcattatcaccttcctttgagtggacaatatgtgcaagatgctgatcggattgaaagtttaggtgcaattggaattgctagagcatttacttatggcggaaaacacggaaataagatttatgacccagaaattaagcctgagaagctaataagtcatgatcaatatcgcaatcatgtagaaaccacaattaatcatttctatgaaaaattatttgatctagaagacctaatgaatacgcctgctgctaaaaaagaagcacatcggagaactgaatatatgcgtgcgtttgttcaagaatttatggatgaatggaatgtgtaattgaagaaaaagagatttgtacccgtattgatacaaatctctttttggtatatattatattttatttttactaagctagtgaatcccaagcaggaagtggagttggcttgctttctgcaagtttcttttgatcttcagttaagaactcttttctaacaactacttcataaacaaattcatcaaaccacttatcgctcattgtgaagtaacctttacgaccagatttttcactccatgagttttcaactttccacttacggatttcacccttatctaagtcaacaccaactaaagtcatagcgtggctaacttcgccttcaccagtagccaatctttctgccttagtcatataagtatcaacatcaaataattcatcggtcttgtataattcagtatctaggtaaccagtcttacgatccatttctttcaagacatcattaccaaaccaaacactttcaccatcttttaattgcttaatagcagcgtcttttaagtattcgattggaacatttaagaaagtaatagggataccaccattaacattgtcttcaaatggaagagagtaaagtttgccatattcatgatctggagcattagttaagcaaacataatcattgaaattaatatcccaatacttattgaaaaattcaactggagttaagtttttatccaagtgaagttttttctcatcatcgcggtactctaagtcaaaagtcttagggggttcgccaacagcaattgcagtcatacggtagatttcgcttagaaattctttgcgtttcttttcaacttcttcagttttaccttcttgaactaatttgcgtaaaactaaagcatcttttctttctttacgagctagcgcatcagataaaccggctgtatgattagtattaaaactttcaggcattgcattggttgggacaacaccgtacttctttactaaggaagcagccattgcccattgaccaccatctgcaccagcaaaattcatatatgctttaactgtacgatcatctaatggcttatctgcagaatcaataattgcatcatagaaaatattagcacgttcaatcttatcccagaagaagttatatgcttgagataaggtgaagttcttagccttatattttttaccaaaatcatggcgtaaagtatttaaggtcgcaaataaccagcaacgacctgattgcatttggttggtaacattatcagtttctacttcgacagagaatacatcgtttagacggttagtaactgctggattaaatgaggcttctaacacaccagatcgcattgctgcgcgagaaactacttgattacgtgaattatcaaagtcactacggaattgatcaatttcttgtagggttaattcgtgagacatagattacactcctttaatttttttatcatgtttttcattatatttactatacagcaaatcacaagttaatacactaattttattgaatgaaagtggctttcatgagtatttaagggatgattctgaagtataatattgataacaatatcggaggaaagaactatgaaaaagaatatttttgtatcaggaattaccctaatgacaatgcttttagctgtaggttgtagtaataatgcaagccaatcgaacactaataatgaagctaaaagtactaagacgagccataaaaagagccacaaatctaaaaaacatacaactaagaaagataagactgatatagatactgataattcagaaactaccagctcagataaaaagactgataagagcagtgaaagttccaagagtagtaatagtgagaagaccagtcagaatgaatcagcaagctctaattcgtctaattcaaatgaatcagaaaaatcaaataattcaaatggctcatccaattcttcagcatctaatactcaaaataatagcggtcaaagtgccgcatcagctaatagctcttcagataccatgtttaacaagatggtttctaatactattaaagaaaacggctattcaagtagttatggaccagataattttacgttaattgatggtggtaatggacaatattctttagctgagaagtcaactggaacaattgttggtcattattctgtaaagaatggtgatctttacaagcaagatgtgattactggaaatgatgttaaggttaaataatggtttattatcagaaaatgacgcctgaaggctatcaagaaattaaagacgagatagcccgtttaaagaaagatcggccacggagaattaaaatcttacaagaagctcgtagtatgggagacttatcagaaaactctgaatatactacagctaagatggaattagggcatttacaaagccgtttgcgctatttagacaagcaattaagatattcagaaattattcaaaaagatgaaagtggaactattgatttaggatcaaatgttactttactttttgagggcgatgatgaggcagaagaatatcgtattgttgggagaatggaagcagatttagctaagggaaaaatttcctttgattcgcctttagggcaagccttaatgaagcaaaaagctggtgcaacagtaactgttgaagcaccagctggaagttatgatgttaaaattattgatgtagattaaaagacatctcgcttatgcgggatgcctttttcttaatctaaatatttattcaatattaattgtattttccttatcttcttcagttaattttggcaaggtaatggttaaaacgccattaacgtcttttgcggaaatttctttagagtcaacatcagggatgcggtaacttctttgaatgtgaccaacgcttctttcccggtgaagaacgttaccgttattattgtctaagttatcgaatgaatctcggctacctgaaacgtttaggacgccatctttatatgaaactttgatgtctttcttatccattcctggcatgtcaactttaacaatatagtccttatcagtttccgctacatcagattgcataatgttcttgatggaactgtcgtcaaaaaagtcttttggaaaactaaaccaatcgcttaattgatccatcatattatcgttattacgatttttcatcatttcgtttgccataataaaacttccttccattacgctctctacaatctctattgtagtaggtccgtagggaaagtaaaatatttagcacactaattagaacggtgctaataagaatgaaaaaataggatttagagtgcttctaaatcctatttttgatggttagtctaaatctttaccgttagattcaataactttcttataccagttaaatgaatccttctttgagcgttctagcgttccgtcacccttgtcattcttgtcaacatagatgaagccataacgcttgtccatttgacccgttccagctgaaactaagtctatgcatccccaaggaagataacccatcaagtcaacaccatctaacacaacggccttttccatttgttcaatgtgttttctcaagtaatcgattcgatatggatcatgaactgacccgtcagcttcacgtttgtcgtaagcaccgagaccattttcaacgataaatagtggcttgtggtagcggtcagttaggtggttaagagagattctcaaaccttctggatcaatttcccaaccccagtcactacgctctaaagtagggttttctacgatcgcttcttgtaagtcagttaattcatctggtttaactttcttacttgaaacagtagtggattgatagtatgagaagccaacgtagtctactgtaccttcttttaaggcaattttatcttcttcagtgatatctggacggtagccatttctttcaatgtaatcttcaacagcatttggatattcaccattaacgtggacatcagagaagaagtcacgtctttgttcaaacttatcagcaagtaaaacatcatctgatgatggagttagaggacgaacaggtgagtaattaatcatacaaccaatttgaaagtctggattaatcttgtggccttctttaactgctaaagcagaagcaactaattcatagtgggctgcttgatacatagcagcttctttttctttatcgcccattccgttcttaaacaagataccagagttagtagccattaagaagtcattgttaaaactagattgattatcaatttcgttgaaagtcatccagtatttaactttattcttgtaacgcttaaagcaaacacgggcaaagcgaacaaagtaatcaattaatttacggttagtaaaaccaccatattctttgactaagtgataaggaatttcaaagtgagaaagggtaattacaggttcaattccatacttatgacattcatcaaataagtcatcgtagaacttaagacctgcttcattaggttcttcttcatcgcctttaggaaaaattctagtccaagctattgaagtacgaaaagctttaaagcccatttcagccattaacttaatatcacccttgtagtgatggtaaaaatcaatggcctcatgattaggatagtttttaccaggaataacgccatcagtaatttcacgcggcttagtggctgatcctactgtcataacatccgctacagacattccctttccatcttcatcccatgcaccttcaagttggtgagcagcaacagcgccgccccataaaaagcccttaggcatagtgtatccagtcatattcaatacgtcctttctaaagtaagcgttttcgaaactcattctacaaattaaaaacttaattgtaaagcttaaaagtatagaattttatttttataataaaacagtgataattattgcaaacggtttcattatggagtattatacaggtgttgtctgaattgttcaggaacaatattaggaggacagatacaataatgaccaaaagagatcagagtttagaacaaaagaaacatgatatgagtgtgagatctataaattttagccgctatttaatgattcggtatttttctgcggcgttcttattcactaatctcttttggttagtttttgcaatttgttaccaaaatattgttgcttcgataatttcgggattattatttgttttattattaatagcttcagtagagcagataagtaagtggaacgtcagaaatactgacttaaaatttacaaaactgtattatcaactccagctaggtgcaaatgtaatctttgctatcagttgctatttaccgtttggaaagactctatttccttttatggctacaaacgatgtcgcaaatgtgatctttacaattttagttgttggaatattaggatctattttgatcttaagaagaattagcaacattcaaaatggtcgcgacaaatatgcaggagcaattaagacatttgaaagtaatagacagtaggacaaattgagggggatgtactatgtctgacattgcgcaaccatcatttaaagataaaatgatgaaggctttaggtaagttctcaggttcacgttttgtacgtgcaattatgggtgctggttattctattattgccttttctatcattggatctatgtttttggtcttaacagtattaccacaagttattactgctaagggatttgtagatttctataacaacactattggtcgttttagcaatatgtatactgttatatataatgcgaccatgggaatcattgcgattttctttgctggatcatttgcttataattatgctgatatttatcgtaaagaagagaacctattgctagatccactaaatgctgttttcttaactttgatgggtctgtttatcactgttccacaattagtttggaaaagtggtagtacgatttttataaatattctaaagaataataacgtagttgctggtggttatggggtatcaggatccggactaactagaattggggcaacaggtatctttactggtttagttgttgcttggttaacagttcaaatttatcgcttctgtattaaacataattggcggattaagatgccagcctctgttccatctggggttgctaactcattctcagctctaattccaggttttgttgttgcatttacaattggaattattgatattatcctcattgtattaggtactgatattttccaactattatacattccgttttcatttatttctgcaattgctgatacttggtggggatttttgattattatcttctttattcacttcttatggtggtttggtatccatggagctactattacatcaagcttttatcaggcaattgttttagcaaatatggcagataacgtaaaaggtggatttcatgtatttgctggggatccaattaatgcatttgttacgattggtgggtctggagcaactttaggtatggctatctttatcgcatttcttgctagatcaaagcaattgaaggaactggggaaacttgaattgatcccagcaatatttaatattaacgaacctttaattttcggtttaccaattgtttataatgtcggactatttgtaccgtttatttgtgctccacttgcttcaggagcagtagcttatgttgccattgctacacatatggtaccaaaaattattgttcaacaaccatggccaactccagttggattaagtggtatgattgctacagctagttggcaaggatttgttctttcagttgtctgtgcaatcgttgcatttttgatatggttcccattcattaagcactacgatagtcaattgcttaagaaggaacaagcagatgctactaaagcataattaaaaagtatagacttttaaaatcttcgtagtttaaaatataactatgaagatttttattttaaggacatagtaatgaaaaaatatgaattagttgcggataaaataaaagcttatatcaccaaaaacaaacttcatcatggagataaattaccaacaattaccgaattaatgaaagaatatcaagttggtaaatctactatcttacaggcgattactttgttaactcaacgaggaatagtttataaagttcaaggttctggcgtttttgtcagacctacagggcgagatggttatatgtcacttactgataacgccgggtttgctcatgttttaaaagatcctactactgaagtaattgagtttgctgagaaaaggccccctaaacctttatgtgactatctgcattctaatgaagtatgttactttataaaaagattgcgcagacaagaaggaaagccatttgttttagaagaatcgtattatcctaagagcattattccgtttatgagtaaggaaattgctgagggatcgatttttgactatatcaaggatggtttaaagaaagaaattcgtttctctgataaatatatgcgcgttagaaagttaagagccgatgaagcaaaatatctagaattagaagaaggagatccctgtttagaagtttatgatactttctatttagccaatgggacaccatttgatagttctaaattggtatacaattatcaaaactctaaattctatgatcaaagttctgatgatattatttaaaaaaatagtcctagtctcaaaatacaaattctttgagactaggactatttttattttggctcttttgcaaatcctgttgatggataattttaagaaggaattaagcagctaagaaatagctgtttgattccttttcttttataatattttcttcgagtctaattctaattaataaatgtttgaaatttctataaccataagcagtacgttcaatttgtttaatcttacggttaactccttcaagacaaccattagaataagttgaggtaataccgtttaggacaccagaataattacgtttaaaagttaatagagtttgatgcatttgtttaccaacattttgttttgaatgaagtagatggataactttcttttcatcgttatcctgaatagcagtcataaagtcctgcataacccaataagtattttctaaggtttggtcacaatctaaaccatctaagacaacatgttcctgtgttagacagtccttaaaatgccagtcgtaataaggagtagtcttattaagtttgtcatatttcatgagataaagcttccaaggggactttaaaagcttatattcacggcttcttttattaaattgcttcatgatttgaactctgaaaatattaaacgatctagtaagcatttgaaccatatgaaaacggtcaataactatctgagcatttggaaataattctctagcaactaaaggataataacaattaagatccatagttactgttttaaccattgcacgagctttaggagtgaacttgtaaaaatagcgtagaatatcaggtttgaaacgagttctaagaatttgaacaactttgtgagtatcaccatctagacaaataaagtgaagctttttgcctacgcccttaaattcatcaaaagctaagtgttcagggagatgatcaaaggcatcatagaacttagaagagcagacttctaatactctttgaaccgtgttgacagatacattatgttctctagcaatgctggtcattgaacgatcttcagtaagagcagaaagtatttttcgcttagaagtgttagagatatagcagcctttattaaccagattagattgagccatagatctttttaaacagtcattgcagagaacacgttgttttcttaatctgatagtaacgggcttactagcatcagcagtaatgaaacgaacgttagagacgtaatgaccgttatgcttaagattagtagaacgacaataaggacaagtaggctggatcagctcagctaaatatattttgtaaatcttaccgttaatattttcatttgaataatcagaaaaaataatgtttttatcttcaatatcaagagtaaatttaatataatcatttaaagaggacatagtttaaatctccatacacttaattgaattggtcgaagaaggattttaagtaagagaggactatggcctctttttttacgtaaaaaaatcctgtcgatagaatatcatagatattcatcaacaggaaaaattatacagcctttattttgtataggctaagacattatttttcatttgctttagttgtttttttgcgccttgctttaactgccagttataaaaccaggtaccgatattagaatgtttcttttcgtcatagctaagaacatcctctttaaaaacaatctgacaaccctgcggtgtatcggttaaatagtagccaattttaatatctattttaggtgacttaaaaactgaaacatattttttaccgaattcatattcagtgatttcggcttttacatttctttgttgatatgttgttcctgcagcaattttaacaggtaagtcattaccacgggattttttaattgcttgagtaagttgcctatctaggtaattaaagaaatcttttgattcgaagtttgcttgttctttgattgtaatcattttgtctgtctttctctatctattttgtcaaaaaaatagaacctagaaaaagctaggttctatcttgttttttagtctaaatcttttccatgggagacaataacttttttataccagttaaaggaatccttaggatatctctttaaagatccatttcctttgtcatcacgatcaacataaacaaagccatagcgttttttcatttcaccagtaccatttgagactaagtctattgctgaccacatggtataacccatcaaaggaataccatcttcattaactgcttcttccattgatttgatttgggcacgaagatagtcaattcgatagtcatcatgaactttatgatcttcagttaattcatcgccccaaccaagaccattttcaacgataaagaggggcttatggtatcgatcccaaaggtcatttaaggcaattcgtaatacatctgggtccgttgcccatccccaagcgttgtagtcaagataagggttcttaacgccacctgcggaaacattaccattagcttttgcgtctgcttcatgtgtagtaagaacattagaagtgtagcaagaaaagcttagaaagtctgctggataattttctattaactcatagtcttctggcttatcatcaagtttgatgccatcacgttcatattgttttaaacgatattcagggtaacgacctccagtttgaacatctgagtaaaagagcatctcttgtttagctttcataactaaaatttgatcagctgggtcagcagtataaggatagtaagcagagtaggcaagcatttgacctacttgattgttttgatcgatttcatgagctagcttaactactttactgcttgctacaaactgattatgagctccttgagcacgattttgttcactaccatcaattaatccgccgcccatataaggagccatgtccatagcattaatttcgttaaaggttagccagtatttaacttttcctttgtagtgattcattacaatatcagcataatgaacaaaaatgtcaatcatttttcggtctttccagcctccaaaacgattaactaaagataagggagtttcatagtgggagagagttactaaaggctcgatgccatatttagcacattcatcaaagaccttatcatagaaggctaagccttctttatttggttctttatcatcgccgtttggtaagatacgtgaccaatttaatgatagacggaacatattaaagcccatgtcagccatatatttaatatcttctttatagtggtgatagaagtctgttccctcatggcttggatagtaatagtcagctaaaggagctggttttgctccttcgggtagtttaaactcttttccccaaaccattggagtagatccagttttgccatcagcagttttccaggtgacttttcttggttcattagcagaaccattagttagtacatcaacggcgtttaatccttttccaccgtctttataaccaccttcatactggtttgcagcactagcaccgccccagtaaaagtctttaggcatagagtagttttttgtcatattttttcctttcttaatttgtttaaatttataaaaaaagttctagaattgctctagaacttttacttaaaagctatttgtctctaaaacgacataatttcgttcattgtagcgatttcggcttgttgaatattcaactggttgaccattgtttaaccagacaatttgttccagctctaagattggatcgtcttttttggcttgaagatactgttgatcccaatcatcagccttagtagccttaattttacgataggcaacgccaaatttaagtttcaaattatgatgaagataattatagatagaattatgtaatatatcttcatttaaatctggaactaagttaactggcataaatgtatgttccagaatcagaggtttaccttcaagccgtcttagacgacgaatattgtaaactggatcgctagattttaattttaagtaatgttgaacatcttcatttggaaattcaacattaaactcaatgatatcgctagtgacctcattagatcctagtagattagctaagccactaaaagcattcgctggtgaatcaaatttatcttgaattggaattgggcctaagacaaaagtgccgagaccagattctttatagactagtccttttctttgtagaccatctaaggccttcttaacggttaaacggcttacgtgtaattcttctgcaagtgttttttggtcaggaaggggagtttgaggtttatagactccatcttcaattcttttttgtagaattcgagcaacttttaagtattttgcttctgcagccattatttttcagccatttttttgtaaacagctactacttccttagctaaatcaataaaagtaatagctgtcattaagtggtcttgagcatgaaccatgtaaaggtcaacttttacatggttaccttgtgcttcttgggttaacatatcagtttgaacattgtgggcatttactaagccttcgtttgcttgcttaataaactcatcagccttttcaaagtcgccttttttagcagcttggattgcttgcatagcagcagcctttgcattaccagcttgcataataattcccattacaacttgcatgttatcgctattttcttgtgccataattttaattctcctagatagatagtatttttaaaataaaagatgctcctgacaattatttattttactatgtcagcaagcatctcccataaattatttttgttttaattcttgaattccttgatcaattgctgcatcacaatcaattggtaattgcagtagcatttgtccgtctacctcaagacctttagggacttggataatacctggaaaatgatagccatgatgagctttagtttcattatctaaataaatagaaacttgtccatctgcgctgacaccaattttaaagtgatgaccgttacgatcaaattcgttaacaatttttacttcgtcgttcatttaactatttatcgcccattaattcttgagcagtttcaagaacatgctcaccattcatcataccgtagtcttgcatgttaataactgctaatgggatgcctgcttcatcagtaatctttttaacactgtcttccatgtattgaacttgaggtccaagcattaatacatctgggtgttccttatcaatttcatcttgaatacctgatgctgcagtagcaaagatcttgtagtccttacctttttctttagctgcgttttgcatctttgatactaaaagtgaagttgacatacctgctgaacaagctaacataatagttttatctgccataataattatctcctttgtaaatctaattaagtgtttttcagtgtttgagtgttgatctataaattaaatgtatgcactttcatcattgaaagcatttacattatagcacgattttgatcataagtgttagttaatagctgaaaaaattatttaccttcagcttcgtccttcttaagcgttgcagcttctctttggactaagatcttgtcgtactttctagcaaatggccagtagatcaaagttgaaataactaatgtacatgcttgccaaattgccatcttccagccaccaattaggaaaccggagataacagctggcattgtccacggacaagcaaaaccattaagagggggaacaataccagttctaattacgaagtaagttgagatagcaactacaactggtgttaagaagaatggaattgctaagaatgggttcataacaataggtaaaccgaataggaatggttcgttaatgttaaagataccaggaactaattcaactttaccgattgaacgtaattgtgctgatttagcagcaattaaaataaagataattaaaccaatagtgatacctgaaccagtcaagttaataaagttgttgtagaattcgttagtaacaacgtgagcaccattggcaatggttaatttaccagctttgtacaattgagcattatcaaaagagttagcttgaagcatagggccagcaagagaaccaacaattaaaccaccgtgaacaccaaagaaccagaagaatggtactaagaatccaatagcgatggcaccaccaagtgaatcagagataccttgaagtggaatttgaagagtttggtaggtccattgtaagaagtctgaaccagtagttaacttaaagcctgcgtaaataagcatagtaccaattaagataattcctgatggaatcatagcagtaaattggttagaaacagcagctggaacttgttcaggtaacttaatagtccagccctttttcataatagctgagtaaatccagccgactaacaaaccaacaatgattgcggcgatcattccgtcgccaccaagccaggtaatgttgaagacacctgtaactggtgattctaggaatgtttgtaaagcgtgtggtaacttatcaatattttcagttactgcttttgcactcattccaccgtcaatacctttagccatggcattctttaatggactgtcaatagttaaagtttgaagcattaagaatgcagctaatgaagtaagaccgggtgctagtggttcatagccttcatttttaacataaatataggcaataccaactgctgcccacatagccatgatactaaaagtagtagtgtaggcttggttgaagaatgcaccccaaccggaagcattaattgcattagctacggctggaataggaatatttcctaaaattaagaaaatagatccaataaggataaatggtaaagtataaatcataccattttgtaaggcttggatagccttagtattaacaaatttcattactggaggcagtatgcgtttattaacaaacacactaaagcctgattgtttttgctcgctcattatatttcgtctccattatcttttaatactttttggaaccaataaaatgatttctttggaacacgttttaaatcttttaagtcatgatttgaacggttgacataaacagcaccgtaacgcttttccatatcggcatgtgaacttggaatatcgattaatccccaacctagataacctaaaactttagctccatctaagaacatggcatccttcatagccttaatatgttcctcatggtaagcaatacgttcatcatcttcgatcatatgctcactatcccaagtttcttttaagccgattccgttttcaattgggaagactggaatcttgtaatggttgtacatagtggtaatagcgtttctaaaaccaagtggatcaattgtccagccccaagcatttgtcttgagatacttgttttctacaccgccataattcatgtaacggttaggagcaacgtcggcaggaattttatcagctgacactgtccaagaagaatagtaactaaaagctaaaaagtcagcctttgcttttttcatttcttctttatcctctttagttatatccaaattaatgttgtggtttttagcatattgcagtacttccggtgaataaccgcggccagtatctgcatcataaatattgaaattcaaaaattcttgaatttgttttgctgcccaaacatcggtagattttgaagtttcaggataaatttgttggaaggcaagcattccgccgatttttacatcatcatatttttcatggatgtaattagccaatcgaatatgactgatcatggtgtggtgaaagatggtatacatatcatctaaagttttgtcacctttttcgtaaccagagatgttaaatacttcgtcttggaagtaaagattatgttcattgaaaacaatccagtatttaactcggtctgaaaaatgatcaatcatctttttgccgaatctaacaaaagcatcaacaacatggcgtgacataaaaccgttgtattcttttgctaggtgtaggggcatgtcaaagtgataaagacaaatcattggctcgattccgcgatcaagcatggcatctactaatttgtcataaaattcaattcctttaggattaaaatccccgtctccttcgggacaaactcttgaccatgaaatttgaatacgatacatattcatattcatttctttcattaggtctaaatcctcatcataacgatggtattcatcaatcgcggtgtgccagtctgtagtattttctgtagcaggtcgtacatcgtaaactgataagcctttaccgtcttcatcccaggcaccttcagtttgcatacttgaaaccgaattgccccagaagaagtctttaggcattttgtgcttattcataatattccctctttgcaatcgcttacatattttacatgtataaatataaacttattttgaggaaaagtaaagcactttcatataaaaatatatacttttgtttaattagataacaaaaaaggactgggatagtttcctcagtcctttttcatgatgctttcaaacacatttatttaataataaaaaagtgtctatataaaatttaatgctctttttcaaaatctgcaaccgctccacgcaaatttgcttcattttttaatgtacatatatccaaaattggtttcacggtctcgatatccatcttatttcttaatttagcaatttcatcgtcgagtaggggaactaattctggattttgtgaaattccaccaccaataataattttttcaggatcaaaactgtgttgaatattaaaaattgctacagcaagagcatggaggagctttccccgttcttcttgagcaactgggtcatcagtgtcagcaagttcaaaaacagtcttaccatcaaaatcttttccagtttttttattgtagcgcttggccatggtaacaggtgaagctagctcacttaactgcttaccatcaataatcataaaaccaaattcaccgccatagagatgtgcaccatgccagatttgattgttaataatgatacttcccccaacgccggtaccaataactaaaaatgccatactactgcatcctttagctgctccgtcagcgatttcggcaagagctgcgcagtttgcatcattttcgatacttactggcaaaccaaatcttttttctaattcaggtacgattttaaagttgtgaatataaggtagggcacttgctccctcaattactccggtagctttattaacagcaccaggagaagaaattgctacaccatcaattttatgatcggcttttatttcattaactgcatcagtcaattcctcataaaaagtatctaaattatctggtgtatcaatcgtaaatatcatttttaatttttgatttatccaggtagcgattttaatagttgtgccgccaatatcaattgcgattaagttcattagtattacctctctttttatcttatctttcatgttaatcatcaacgtaagcgctgtcaataagtatatatttttcctgaagtataactaatagtaaatgctttgctataattgaaaataattgatataaaggggaaaagacatgaatacaccatcgtccagacaaggaaatttgactagatatattgtttatttggtcttatatttaattgtaattggagttaaaaaattagctctgttaaatgatcatgtaaataaaatagggtacttttttttcttactttgtgccttgtttactttatatttttatattcgacaatttaatcgagaacaacgattttttgaaaaaaagcccacgatgcctttattagcagattatggatttatagttggtgtatctattctggtgattttaggacgtgtttttgtttcctatcttcaagctaaaggaagcgtgcccttaatgtcttttcaaataatttatcaaaaggctgaatgtaatcttttattttggtttcttatattttcgactggtcttttgctaccagcaatgcaagtatatttaacaacaggttttttctttaattatgggtttagagcacagaatatggttagtggtatagttggcattatgtgctcaggctttttctatggaatacttaattttcaaacttcatttagtttatttattctcaatagtctttacgggatgctttttgcttggtcttacttatattcacaaagaatcatgatgccaatttatttagcaatcctaaatggaatttttatggtgattttagcctaacaaaaaacgaggaacttcataaagttcctcgttttttaatataagcggatagcgtgaatcgaacccgcatcttcagcttgggaagctgacattttaccattaaactatacccgcataagcaaaatgattatatcattttgctaacgatgtggcaactgatgtctgtctaggttatattctgaccggtcaagtagagaagtaaagttttgaaagagccaacgacgtaattcagatggctttaacactaagggcattctttcatgaactggaagcacagtatcattagaagcagtagtgaccattgaaaagtcatcccctttataaataccagcaattaatgccatcggttcatcttttgcagtaaaagatgagtgttcatgataggttttgttatttgatgcaaggtaagtttgcttactactttcccagaattcattagctaaaataatgcaccgctggcgagcaaatgaatcatcccacattgatggtttttcttcataaaaacgctctacccgagcattataaattactcgattctttttaaatggacttggatagccccatttcttttcaactaactttagttcgtcatcgctatatagcataactaaagatggagatttaggataaatttgagtaacagattcaaatttgtcttcaatgttttttgatacaactagtggtaattctaaatcagtttttagatatgtcttaatttctttaagcgatggcatttcataatgactacacatctctattcatcctttctttatgtaatttttctctcaatttaattttagcaacttttaggtaagtttaaacaaataaggatttttgctagaattggaggtaaagctaaagattacagatatattggagaaaaaatatgacaaaggaaattttattaactggagatagaccaaccggaaaacttcatattggtcactatattggctccttaaaaaaccgtgtaaaattacaaaatgaaggtaaatatgacccttatattatgattgcggacactcaagcactaactgataatgctagagatcctgaaaaaattaagaatagcttaattcaagtagctttggactacttagctgttggactagatcctgaaaagtctactatctatgtgcaatcacaaatccctgctctttttgaattaactgcttattacatggatttggtaacagttgcacgtctagaaagaaatccaactgttaaaactgaaattaagcaaaagaattttaaagattcaattccagttggtttcttaaactacccagtttctcaggcagcagacattactgcttttaaagcaacaataattccagttggggatgatcaagaaccaatgcttgaacaaactagagaaattgttcgtacttttaatagagtttataacactgatattttagttgaaccaaagggttacttcccaccaaagggacaaggtagacttccaggtttagatggaaatgcaaaaatgtctaaatcacttggaaatgcaatttacttgtccgatgatgcaaagactgtacaaaagaaagttatgtcaatgtacacggatccaaaccatattcatgttgaagatcctggtcaagtagagggtaatactgtctttacttatcttgatgtttttgcaccagataaagataaggtggctgaacttaaggaacaatatcaaaaaggtggcttaggggacgttaaaattaaacgctacttgaataaggttcttgaagaagaacttgggccaattagagagcgtagagagaagtttgctcaagatccagatgctgtatacgaaatgttactagagggatcaaagaaggcaaatgaagttgctaaccaaactttacaagaagttagagaagcaattggtttaaattattttgataggttaaataaataatttaaagagggtaagactgatgacaagagacaggattccgtggaagcaatattttatgatgcaggcgttagttattgcacagcgctcaacttgtgaccgagccctagtgggaagtgtgttggtcaaggacgaccggatgattgccactggttataatggaagtgtttctggacaacctcattgtgatgacgttggtcacttaatggttgatggacactgtgttagaactattcactcagaaatgaatgccttaattcagtgtgctaaaaatggtatttcaactgaaggtactgaaatctacgtgacttattttccttgctttaattgcagcaaatgcttagttcaggctggtattaagaaaattaactattattatgattatcatgataatccgttagcactcaagttactgcgtgaaaagggtgtggcgattgaacaagtaacgctagatcataaatatgttcaaagcttagctgagaggttagagaagacggataatgaaaaataagtttatcagttttggaatactcctaatttcttttttactatttactgctagtacaacttcttttgttagtgatctgcaaaatttatttaataaccaaactaaagaattagtaactcaaaaaaataaagagtatcaaaaaacaaaaaataaacctgagattcggcttttaagtctaaaaaatagtaatgatataaataaaattaggccgatgaaaaatcaggtaattattgtagctgcattacaaaataaaagaaaaaatgttcaaattcttgttggtaaaaattaccaagatgttttgacacaaaataagtgtagcaacattattcgatatgcaggcgataaattaagaagtgagaaaaaatcaagcttcaactcaggaattcgattagtttttaatgcctgtgcaactttaattgtccaaaaagataagttatcttatgataaaaattctttgacgcaagaagagttacaaaaaattgatcatccacaaagtgtaagtttagtttggggattagtgattgcagctttaattagttttggattagttttattcaaaagcacgcgaaagccacattagggcttgactaaaagctagttagccgttaaagtatcaatagaaattaaatattagagcaaataaactgttaggtgagactcctacgtgaacacatgctgtcgcccagcaacatccagagatgccaacgggtcaaacagggatcgtcgatataaggccctccccagccagctagttatatttttataaccttacgtcacgtagtgttaaaactgaacgacgagtataaaaatcgcttggatttaagccgatgcagtttttgcatcggctttttgtttgtttgctaggttcttaagaaaggatgttgaagatgttaaaaatcaacacttccggcaaaagacatactacagacaccaagctggtgcgccggattgcatgcgaagataaatttgcaacactgcaacgattaaaaacctcaattagtggccttcaaactaaagatgcgaggcaacgcttagcaaaaaatggtcctaacgaaattgtaaataaacctaaaaatactagacttcaatttttatgtgaagcatttatgacgccttttacaagtattcttttaggcttagcaattgtatctattatgcttaactataaattaaaagttcataatttagatacacctgttttaattattttagttttagctatttctggaatattaagtttcattcaaaatatcaaaattagagcggctattcaaaatttactacataaaatatcacccactactaaagttatgcgcgactgcatgccacaagagttggcaactaaagagttagtggctggggatattatcttgttacaagctggagaagtggttccggcagatgtaagaattttaaagaataataatataatttgttcagccgatttctttatggatgaagataatccagtatataagagtgaaattacttctttaggtcagagaaacaatcatggttatgtagactatgccaatattttatacgcaggtaccagaattatctctggttctggagttggagtagtatttgcgactggaaaagagactatttttggaaaattatctcaaaatatttccaagatggaattaaagaagcacgtgtttaatttagataccagaaatttaacaagagtatttttaattctagctgcagttattgttcctttgtttttagtaattagtagtatgatgcatggcaactgggaaaatactttagtatttgctcttgcagtagttgtcggattaacctctgatgcagttcctatttctatcactagccaattactaaaaaattcaattcaccatccgagtaatagcatggtaatgaaaaaacaaaatcaatctaactaggaatttctaaaaagaaattccttttttggtacacaaatttatgtaggcatgctatgttatactagcagttaaaagacttatgagaggaagaataaagatggctgaaaagaaaactttctatattactacacctatttactatccatctggaaaattaactatcggtaatgcatacactactattgctgctgataccatgactcgttataaaaaatctcgcggttttgatacattcttcttaactggaactgatgaacatggacttaagattgagcaaaaagctgaagcacaaggaattaaaccacaagaatttgtagataaaatggctgattcctataaggacctatggaaaatgttagacgtttcctatgatcgcttcattagaacaactgatgaagatcacgttaaagctgtacaaaagatttttgaaagattattaaaacaaggagatatttacttaggtgagtacactggttggtattctgtagaagatgaagaatacttcactgaatcacaacttgctgaagtatataaagatgatgatggcaatgtgattggcggaaaggctccatcaggacatgaagtacgtttagttaaggaaccatcatacttcttcagaatgagtaaatatgctgatcgcttacttcaatactacaaggatcacccagactttattttgcctcactctcgtgagaaagaaatggtaaataactttattaagccaggcttagaagacttatctgtcactcgtacgactgttgattggggaattcctgtgcctagtgatcctaagcatgttgtttatgtttggattgatgctctttctaactatattactgctcttggatatggttcagataatgatgcattatttaagaaatattggccagctgacgtacatttagttggtaaggaaattgttcgcttccacactatttattggccaattatgttaatggcacttgatcttcctcttccaaagcaaatctttgggcatggctgggtattaatgagagacggtaaaatgtctaaatcaaagggtaatgccgtttacccagaaatgattgttaaacgttatggcttagatgctcttcgttattacttgatgcgtgcaattccatttggttcagatggtatttttactccggaagattttgttgaaagagttaactttgatttggctaatgacttaggtaacttgttaaatagaactgtttcaatgattaatcaatatcaagatggccaagttgctccagttgcttcagaacaggatgaatttgcaaaagatttaattaaaacagctaatgaaacaattgctgaatatcaaaaacaaatggatgccctccacttctctcaagctttagatagtgtttggaagctcatttctcgtgcaaataaatatattgatgaaactacaccttggacgttaaacaaagagggcaagagtgaagaactatctaaagtaatgactaacttggctgaaagtttacgtttaattgcaattttaattgcaccagttatgacgcagagcccagttaagatgtttgaacaactcggacttgactggaagaatgatgatcaaaagaaacttgattttggcggctttgactggaacattaaggtaacagaaaagccgacgccaatcttcccacgacttaaaaatgatgttgaagttaagtacattaaggaagaaatgaagaaggctaagccaaagaagaagactagaagtcaacaaaaagaagaaaaacacattacaattgatgattttgacaaagtcaaaattcaagtaggtcaaattttatccgttgagccagtaaagggatcaagtaaattattaatgtttaaacttgattttggtgatggaaacgaacgtcaaattttaagtggtattcgtaagttttatccagatgcaagtgaacttttagataaaaaggtccttgcagttactaacttaaagccacgtaagatgctaggacatgaaagtcaaggtatgcttttatctagtgaaaaggatggcaaggttaagttagctattgttggcgatgaacatgaggttggagctgaattaggctaatggagatttttgattcgcatacacacttaaatgatgcatcttttcgcggaaaagaagacatttatcttgaacgagctaaagaattaggtgttgtgaaaagtgcggttgctggacaagatcctgaatttaacgaacgtgcgattgacttgagtcaaagattcgataacttatatgctattgttggctattgcccggatgttgctaaagactatgatcaaaaagctgaggataagctagttgagcaactaaaagaacctaaaactgtcgcgttaggagaaattggactagattattattgggatgaatccccgagagaggtacaacgcaaagtttttgcgcgacaacttgatttggctcatagtttgaaaatgcctgttaatattcatactcgagatgcttttgaagatacttatcaagttttgaaagatagtcatgtcggtgaatatggtgggataattcataatttcaatggtgatccggaatggctcaataagtttcttgacttagggatgatggtttcattttctggtgtggtttcttttactaaagcagttgatgttcatgcttcagctaaggttgtgccgtgggacaaatttttaattgaaactgatgctccatatttaacaccgaagccataccgtggaaaacaaaatgaaacaggatatgtgcgttatgtagctgaagcaattgccgatttgcgtggaagctctgttgaagaagtagccaagcatacatttgagaatacgatgagggcatatggaatcagaaaataaaaaacaatttaatgctgtaatagttgttgaaggtcgagatgataccaaacgtctaaaacaattttttcctggaattgaaactattgaaaccaatggttcagaggtatctgaacaaactttagctgaaataaagaaactttcgcaaactagagaaataattatttttactgacccagattataatggcgaaaggattcgacgtttagttacccaagcagctcctcaggctaagcaagcttttattacacgcaaagaaggagaaccaactaagcgtggaaatagtttaggagttgaacacgtttcaaaagaagctttgattcgtgctttaagtgatttgcatgaagttaaaccgatagaaagtgatatcactaaggaaaagtacgatgagttaggcttaggaatgagctcgggtgctcgtcttttacgtgagaaggttgggattaagctaggaattggatatggaaatagtaaacaattttataaacgcttaaagatgtttggaattacttatgatgaattaaagagggcagttgaagatgtcaaatagtatgccgattgcaagtccagttagaactcaagcaattgttaatcgctattttatgcatgcgaaaaagaatttaggtcaaaactttttagtagatttaccagcaattaaaggaattgttgaagcagcagatattcagccaggagaccaagttattgaaattggacctggaattggttcattaactgaacaacttcttttagctggagccaaagttttggcttatgaggttgatcaagatttaccagaaatcttaaacaatgaattgccacaaaaaattgatggtgaagaattgaaagatcggtttaagttagtaatgaaagatgtattgaaagctaactttgtagaggataatgatggctttcttgatttaagtaaatcagttaagattgttgctaatttaccttactacattacaactccaattatttttaatctgattaagagtgatttagatttttcaagtttaaccttaatgatgcaaaaagaagttgctgaacggttagttgctaagcctaaaacaaaggaatatggtcccttgtctattgcagtgcaaagccggatgaatgttcgcttagccgaagaagtaaagagcacatctttcatgccaagacctaaagttgattccgcggttgttgtcttaacgccacttcttgaaaagcctgacattaatgattatgcattcttcgatcatgtagtgaaaatgtgttttgctcaacgtcgtaaaactttagctaataatttgaagactttaattaaagataaagatgaacgcgagaaattaattaatgatctagggttagatgttagagttcgtccggaagaattaactctaaatcaatttgttcagttggcacatcttctaaaagatcggcaagcataaaacggttacaaattacagacttgaaaaaatattaaatttttgataaaatgaatccaagcaaaggagtgacgtccagtgccaacaacactaatggcaattaaacaaagtttggattctcatttgggtgaaaacttagtagtagtagctcaagcaggaagaaaaaaagtaacccgtcgtaaaggtagattaactaagacttatcgggctgtatttgttgtagatcttgaccaagatcaaaataattttgaacgagtatcttatagttataccgatttattaaccaaaaacattgaacttgagtttgatgaaatgtagtcgacaatagaatattacgaacaatcactagtatttcacttaaaatgctagtgatttttctttatatagagtatatttaaacgtagaaatctatttaatgtttaggaaggtaaaagcatgaaacgttcagaaagattagttgatatggttaagtatcttttggctcgccctcatactttgattgcattaccattttttgcagatcgctatggtgcagcaaaatcttcaatttcagaagatttggcaattttacgtcaaactttagccaacgatcaaaatggaattttagaaactgtagcgggagcagcaggtggagtaagatacattccttttgtaggaaaaaaagaagctacagactatcttcatgatttagctgaccgtattgaagatcctgatcgtattttacccggtaattttgtttacttatccgatattttaggttcgccgcaagatttacgtcaaattggacaactgattgctaccaaatatgcctacagtaatattgactatgtaatgacgattgagactaaaggaattgctcttgcacaagcagtaagtcgtttcttaaatgtgccatttgtaatggttagaagacgtcctaaaattactgaaggatcaacaatttcagttaattatgttgcttcttcaagtgaacgagttgaaaaaatggagttggccaaaagactcctcccagaaggaagtaatgtactaattgtcgatgacttcatgaaaggtggaggcactttaactgggatggaagaactagttaaagaatttaaaggtactgttgccggtatgtgtgtactttgcgaaacaaagtatgcctctcaaaaagtagttgatgactaccaatctttaattaaaatcactgaagttgacagggataagaaactaatcaaagtacgaccaggtaatttcttagagcagacagacttcaatcgtttcccaaaatgatatactgatagatagcttaaatacaatattgaggggatattaaattcatgaataaatatgttgttatcttagctgctggaaaaggtacccgtatgaagtcaaaactttacaaggtattacataaggtttgcggaaaaacgatggtagaacatgtcgttgaggcagcaaagggaactaatccagataagattatcactgttgttggtaatggcgcagagagtgttaaagatgtattagcaggtcagtcagaatttgcttttcaagaaaagcaattaggaactggagatgcagttttagcagcaaatgatctattagagaatttagagggatcaactttagttgctactggggatactccattatttacagccgaaacctttaataacttatttaaaaaacacgaagagagcggaaatagtgcaactgttttgaccgcaaaagctccaaatccatttggctatggacgtatcattcgtgacgaagatggaaatgttctgagaattgttgaacaaaaagatggtactccagaagagttagctgttgatgaaattaatactggtgttttttgttttgacaataaagaattatttaaagctctaaaacaagtaggtaacgataacgcgcaaggtgaatactatctaactgatgttttagaaattatgcgcaaggctggtcacaaggttggtgcatatgaaatgccagactttagtgaaagtctaggggttaacgaccgaatagctcttgctcaagcaactaaaattatgcaaagaagaatcaatgaggaacacatgagaaatggtgtatcatttattgatcctgatactgcatatattgatagcgatgttaaaattggcaacgatactgttatcgaaggaaatgttgttattaagggtaaaaccgaaattggtagtaactgctatattactaatagttcaagaatcattgactctaagatcggcaacaatgtaactatcacttcttcaactcttcaagaagctcaaatggatgataatactgacattggtcctaactcacaccttcgtccaaaggccgtaattcgcaaaggtgcacatattggtaactttgttgaaattaagaaggctgaaattggagaaaataccaaggtaggacacttaacttatgttggagatgcaactttaggtaaagatattaatattggctgcggaactattttctctaactacgatggcgttaagaagttccatactaatgttggtgatcattcattcattggtgcaggtgctacgattattgctccagttaatattgctgatcatgcatttgttgcagcagattctacaattactaaagatgttgagaagtacgatatggcaattgctagaggtagacaaactaataaaccagattattggcacaaattacctttggcaaaagacaaagaatgggaataaatttaaaagaagttgttaaatacaacttctttttttgctatttacaagcgtaacaagcatttttttgctattattaaatgtggaattgtaatttttcggtggaggaaattatgtctcaattagacaaagaaattaaaatttttgcgctcaactctaataagcctttagcagaaaaaattgctgataaggtgggagttaagcttggtaagtctgatgttaaacgtttcagcgatggtgaaattcaaattaacatcgatgaatcagttcgtggtaaagatgtttatttagtgcaatcaacttcagctccagtaaatgataatttaatggaattgttaatcatgattgatgctgttaagcgtgcttcggctagaagtgttaacttagtaatgccttactacggatatgcacgtcaagatagaaagacccgtgcacgtgaaccaattacagctaagttagtagctgatatgttacaaaaagctggtgctgatcgagtactttcacttgatttacatgccccacaaattcaaggattctttgatatccctgttgataatttgatgggtgcacctcttcttgcggactacttcttaggccatgatttagaaaaagatgctgttgtagtttcacctgatcatggtggtgtaactagagcaagaaagctagcagaattccttaagactccaattgcaattgttgacaagcgccgtccaaaggcaaatgttgctgaagttatgaacattattggagatgtaaaaggcaagcgtgccattattattgatgatatgatcgatactgctggtactattactttagcatctcaagctttaatggatgctggtgcaactgaagtttatgcttcagctacccatgctgttttatcaggtcccgcaattgaacgtttgaataattcaccaattaagaaattgatcttaactgattcaattaaccaacctgaagaaaaagatttatctaaggctgaaattgtttctgttggaccattaatgggtgaagcaattaaattgattcaagaacataaaccagttagtccactatttaatactcgttttcaatcacataattaagtaataaaaaccaatatctatctacttaggtattggtttttttgtcctataagagctatacctttattttaaaaatagaaaaagcgtttacatatctcggataattaaggtagtattaaactatacagttttgaagaaggaactatgagaatatgactactttatctgatgtagcaaaaaaagctagtgtatctaagatgacagtatcgcgggttattaatcatccgcaacaggtgacgccagaattaagaaaaattgtggaaaaagcaatggagcaattgaattatcatcccaattcaattgcgagtgctttagctcataatcggactaatgtggttaaattggtaattttagaagatattgatacaaccgagccatactatatgaatctactttttgggattgctaaaggactaagcaaaaaacactacgcaattcaattagccacagacaggaatgttggcggaggagacggctatattataactggtgggcgagcaacggatgcagaatggttagatcaattagataaaccttttgttttatttggagaaaatcgttatggctatgattttattgatacagataacaaattaggtgaacagctggctacacagtatgcacttaataaaaattatcaatcaattgttttcattggaattgatgaaaaagagccttttgaatattcaagggaagccggctatatcaatacacttcagaaacataatatgattccaaaaatttttcgaatccaaaaccatagtagtctggctgaaaaattaattattgataattggagaaaatttgcaccgaatacatgctttatttgtgctagtgatcgaattgcagtcggagtagtacgagctatccaaagaaagaatggaaatattcctcgggattttggtgtgattggttttgacggagtctttttagatcaagtctcaaatcccaaactcactaccgttaagcaaaatttatttaagctcggtgagcttttagctgggatgattctgcaaaaaattaaacaagatggagcccagcagggtgaagtcttgattgaactggaactaataaaaagtgaatctacaagaaagtaagaagctggctaaacagcttctttttttgataccggtaacagataaaatttattgtaagcgcttataataattgcttaaaataaaattcatggaggatgtgtattatgagacattggtatgatcaagcaattatttatcaaatatatcctaagtcttttcaagattctaataatgacggtattggtgacttaaatggaataagaaagagaataccgtatttaaaggagttaggaatcaatgctgtttggctaaatccaatttttgtttctccacaagtggataatggctatgatgtatcaaattattttgctattgatccaaagatgggaacaatggaggatatggacaacttaattaaagagatgcatgaggctggtattcatgtaattatggactttgtattaaaccatacttctgatcagcatccctggtttcaagatgctataaaaaatccagaaagtatatatcgtgactattatatttttgctggagaaaacaatcagcgtccaaataattggggaagttttttcggaggaagtgtttgggaaaaggatcctgcaggaactggacaattttatttccatctttttgataaaagaatgcctgatttgaattggaagaatcccgaagttagacatgcaatgaccgagattgcaaaatattggttggaaaagggtattgatggattaagactggatgcctttattcatattgcaaaagccgatctaagacagaattttccggttaatagtaaagatgaagagccagtaattgcagaaccattttttgctaatttaccacaagttcaaaaatggatgcgactgttttgtgaggaaataaagcaagattatcctgatgcattacttttaggagaagcagcaagtgcaaatgtgaatttggctgtggattatacaaataagaataatcatttaatggatagcgtaattacttttagatattttactgaagatcaaagtaagatcgatcctagttttttgagtaattatcaacctaagcccttagattgggttaaatttaaacaaaatcagactatttggcaacagaccttaagtggaatttctaaacctactctttattggaataatcatgatatggcgaggctggcaactaggattgctaaaaatgatattcaagcaagaagtttagcaatgctgatgtacttacagtgcggtattccaatcatttattatggtgaagagctggggatgaaaaatttacagtttgaagatataaatgattttaaagatgatactgtaaaagagtttgtgacgagcgcagaaaaagcaggtaagacttcaaaagaagcattgttaatggcaagcaaaacccataagcttcctgctcgaggtccaatgccatgggataacgaaagaaataatggctttacagagaaagagccttggattaaaggcaggaagcttgataaggtaaatgtagctgatgaaatagcagatgatagtagtatgtttaacttttacaaaaagcttattagcttgaagaaagaacaactatttcaagagggtaattattatttatggccaacgtcaaatgggagctatgtctatgagcgtaatttaaaagacaaaaaagcacttattgctgtttctttgagtcaagaaccgattgagcttgaagtaggaaaagaatttagtaatgaaagattatcagctggtcaatatgatttagtggcaggaaaattaagactagagccatatgccggcgtagtattagaaaattaaaaagattgaggaataaaatatgcaacttgcagctttaaaacacagaactgaaagtgaaaattgttttgttattgatcattcacacgttaaaattagacttcatacggcaaaagatgatgtggaaaaagtaattgttcattacacggataactatctcccaccaaaacaagctaaagaacttgaaatggagaaaataggtagtggtcaagttaatgattactggggagcaaccttaactgctccatatcaccgaattaaatatacttttgaagtgataggcaaagacggaagtcatgtgatcttcggtgatcgtagtattgaaaaatttagcgataaaaagttaagagaagatggaatgtattttaaagttccgtacttccatgatattgatcgcatcaagactccaaaatggcttaaagatattgtttggtatcaaatttttccagagcgttttgctaatggcgataaaagtaatgacccagcaaatgttaaagaatggaatccagaagatcatccaggcagagaagatttttatggtggagacttacagggagttttagatcatctagatgatctacagaaattaggagttacgggattatatttctgcccaatttttaaggcaagttctaatcataaatatgacacaattgattatttacaagtagatccagcttttggagacaaggatttgtttgcaaaagtagttaatgaagcacataagcgtgggatgaaagtgatgcttgatgctgtatttaatcacttaggtgatcaatcaatgcagtggcaagatgtcgttaaaaatggcgaaaaatcacgttttaaagattggttccacattaattcatatcctgttgaaccatatcgggacccaagtaaaggtgaaaataatccaccatatgaaacttttgccttcgaaaaacatatgcctaagttaaatacggctaacccagaagtacaggactttttattagaaattgcgacctactgggtaaaatattttgatattgatgcttggcggctagatgttgcaaatgaagttgaccaccatttctggaagagattccatgatgaattagttaaaataaagcctgatttttatattgctggggaaatatggcattcagctcgtccatggcttcagggggatcaatttacaggtgtaatgaattatccatatactttacaaattgaagaccacttctttaaacataaaatggatgctaaagaccttagtgaacacctaactgatcagttaatgatgtatccagatatggttgaccaggctatgatgaatatgcttgattcccacgatacggctagaattttaactttagcaaaagacaatcaagatttagctttgcaagcagttgcgtatgaatttgttcaacctggagtgccatgtatttactatggaacagagatggggatgagcggtgataatgatccggattgtcgtaaaccaatggattggagtaagataaatggtccggtatggcaaagagttcatgaattagtgaaattcagactagatcatagtgataccttaaataaaggtactgttaagttaacggtaacagaaaaaggacttctaaaagttgaacgaacaggcaaagaaacaataaaggcctactataataccggtaaacataatgtaaaaattgataaaacagcagctcttagtcagaattataaagcgggagtgttagcgccaaatggctttttgattgaggttaaagcttaatatatgaagaataaaaagcagcaataagatgctgctttttttcttataaatttttgataccggtaacattaaaacaaacattgttaagcgctttcaatgattagataatagatttgtaaataaaaagacttcacgaaagtgacggagaatgatgatgaagagaatttttgaggttgatccttggaaagtaacgacacatgaattttctaaggaagataaaaggttacaagaaagtattactgcaattggtaacgattatatgggaatgagaggaaactttgaggagggttactctggcgacacacttcaaggaacatatttagcaggtgtgtggttcccagataagacagttgttggttggtggaaaaatggatacccaaaatactttggtaagacaccaaatgctccaagttttattggaattggaatcaccgtcaatggtgaaaaaattgatttagctaaagtaaagtttagtgattttgaattatctcttgatatgcatcaaggacttctttcaagaagttttatctatgaaggtaaggatgtcaaagttagatttgaatttgaacgttttcttcatatcgtacaaaaagaagcggctttgattaaagtaaaagctacggtacttgagggaaaggctaagattgattttgattctacgttagatggaacagttgttaacgaagatagtaactatgatgaacgcttctggattccacttggtgagaataaggatacaaaaactattcaggtaaaaactaagcctaatccttatgaagtgcctcaattcacagttttacttaaagaatctttgcgccacaatggtgaactaattcaaactgaagtttctactaaagaagccaagttgagcgaaaaattttcagttgaattaagtgaaggacaaagctacgaacttgaaaaagacgttattgttgtaacaagtagagatgttgaagaaaaagatcaagcaagtgttgctgaagatttaatgaataagcttcaatcaaagagctttgaagaaaacttagccgaccatactgctgaatggcaaaaacgttgggacatgagtgatgttgaaatttctggtgatgcagcagcacaacaggggattagatttaatattgctcaattgttcatgacatactacggtgaagatgaacgcttgaacgttggtcctaagggatttactggtgaaaaatacggtggtgctacttattgggatactgaggcttacatcgttccaatgtacttaggaattactaacccaagcgttactaaagcccttcttcaatatcgtcataatcaattgccaggtgcatgtcacaatgctaaggaacaaggccttccaggtgccttgttcccaatggtaactttcaatggtattgaatgtcataacgaatgggaaattacttttgaagaaattcacagaaatgctgatattccacatgcaattgctatgtataccgaatacaccggcgatgatagctatgttaagaatgaaggtatggatgtcttagttggaactgcaagattctgggcagctcgcgttcactggtctaagtggcgtaacaagtatgtaatgcatggtgttaccggaccaaatgaatatgaaaataatgtaaataataactggtttactaatactatggcaagatggcttctgaaatatacactagagcgtttgccgcttgcaactaaggaagcacaagaacgagttcatgttactgaagaagaaaaagaaaagtggcaagacattgttgataagatctatcttccagaagataaagagttagggattttcttacaacaagatgattttcttgataaagagattcgtccagtaagtgaaattgaagatcaacgtcctattaaccagcattggtcttgggataagatcttaagatcaccatttattaagcaagctgatgttttgcaaggtatctatttcttcccagaaaactatacgaaggatcaaaaagaaaagaactttgatttctatgaaccgttaactgttcatgaaagttccctttcaccttcaattcactcagttttagctgctgaattaggaaagaaagataaggcagttgaactgtatgaaagaactgcaagacttgatctagataattacaacaatgatacagttgatggtttacatattacttcgatgagtggatcatggttagcgattgttcagggctttgctgggatgagatacgaccatgaccaattgaaatttaagccatttattccagataactgggaccactatagctttaagattaactaccgtggtcggttaattaaggtttatgttgatcatcaagaaaccaagatctctttacttaaaggtaaagatctagaaatttttgttaatgataagaaggtaacgcttaaagaaggtgaaagtgaatgcttaaaggactaatttttgacttagatggagttttaacaaattcagctgtctatcatttaactgcttggaataatttagctaaggaattagggattaacttaacggatgatcaacttgatagcttaaggggtatttcaagaatggattctttaaatctaattttgaaatatggcgaccaggaagataaatattctgaagcagaaaaagaaaagttcgcagcagaaaagaatactaaatttgttgaacaagttgaaaaaatgacgccagcagatattttgccaggtattccggaactacttagtgatgcaaagaaacaaaacttaaaaatggttattgcttctgcctcaaaaaatgcacctaagattttaacaaagttaggaattatggatgaatttgatggcattgttgatccagcaacacttcatcacggaaaaccagatccagaaatttatgaaaaagctcaagaattagctggtttaaatgcagacgaagtaattagttttgaagatgctcaagcaggtgttcaatcaattaaaagtgctggtcaatttgcagttggaattggggataaagaggtcttgaaagaggctgattatattgttccaactactaaagaattgaaactttcagaaattgaatcagtttttaataaaaaataagagggaagtagggaaagagaatggttgaagtagatttaaaccatatctataaaaagtacgaaggaaatgataaatattcagttaatgactttgatttacatatcaaagataaagaatttatcgtttttgttggaccatctggttgtggtaaatcaactactttgagaatggttgctggtctagaagatatttctaaaggtactttagagattgaccataaggtaatgaatgacgttgcacctaaagatagagatattgccatggttttccaaaactatgctttgtaccctcatatgtcaatttacgacaacatggcttttggattaaagcttcgtcattataagaaagatgaaattgataaacgagttaagcatgcagcagatattttaggtttatcagaatatcttgataaaaagccagctgaattatctggtggtcaaagacagcgtgttgccttaggacgggcaattgtccgagatgctccaattttcttaatggatgaacccttatcaaacttggatgcaaaattacgtgtcacaatgcgtgccgaaattgctaagttgcaccaaaatttgggaactactacgatttatgttactcacgatcaaactgaagccatgactttagcagatcgggtagtagttatgtcagttggtaaagttcaacaaattggcacacctctagaggtttacaatacgccggtaaatatgtttgttgctggttttatcggatctcctcaaatgaacttctttaatgttcactttaaaggaaatcgaattagcgatggaaaaggtctagatatcgaaatccctgaaggtaaagcaaagatgcttaaagaaaagggatatgacgataaagatctagtatttggtatccgtccagaagatattcattcagaggaagcattccttgaaacttggcctaaccaaattgttgaatcaactgttgttgtttcagaattgcttggttcaactattcagctttatcaaaaagtagatggaacagaatttgtagccattgtaaatgcccgtgattaccatactccaggcgataaagtaagaatgggatttgatgttaataaagcccacttctttgataaagatacaacgaatgctattcgttaacttgcaggagaggacgcttctgcaaaatattgattgggtttacaacgagtgtgaaacttggttcacggttgtaataatgtatttagccagtcatggctaggaggaaaaatcatgaagttatggaaaaaattggctttaggtagtgttgtagcaatatctgctatttcattaactgcttgtagtaacaactctaactcaaacgaatcaaagagctcaaataagcaattaactctttgggtagatactgctcgtgttagttggtataagggcgtggtaaaggactttgaaaaagaacatcctaatattaaagttaaggttactcaaaaccctaatggttcagctaatgcaaaaactgatgttgctaaagacccttcaaaagccgcagatgtatttggtgttccaaatgaccaattaggacaaatggcagattcaggttacattaacccattgtcaccaactgatactaaggaaattaagaagaattccgttccagaagcatacaagggtgttgaatggaaaggcaagctttacgcatatccatattctgaacaagctcaaactgtttactatgacaagtctaagctttcaccagaagatgttaaatcttggaagactatgacttctaaaggtgtagttgcaactgacttcactaatgcttatgtaatgtggccagtaatgttctctgcaggtacaaagttatttggtaatagcggagaagatgtaaaaggctccactatggattcacaaaatggtgtaaatgcaatgaagtggtacgctgaacaaaagaacaataaaggcgttatgcaaacttcaaatgcacttaaccaattaaagaagggtaatgcccaagctatcttagatggtccatggaacgcagctaatattaagaagattttaggtaagaacttaggagttgctccatatccaaccattgaagtcggcggtaagactgctcaaatggaagctttcttaggtattgaatgtttcgctgttaactcacatacttctaatgctaagaatgcagcaattttagctaaatacttatctaacaaagaaaaccaattaattgttcacaagaatgctggtgaaattcctgtaaacaaggcagctcaaaatactgcagaggttaagaacgatccagttgctaaagctgtaattcaaatggctcaaccaggctactcagttcttcaacctaaattgccacaaatgtcaatcttctggaacgactcagctccattaattagcggtgcttacgacggcaagattaagccatctcaatacaagagtaagcttgctaaattacaaaagaagatttctaaagaagaataatcttaaaaaaacacataagcaaaggtttgattaattatgtttaagaaaaaacatgctacgcctgcagttaccttaaaggaaacatggaaagatggagatgcagtaactaaattatcattcttcatcatgggcttaaatgctattaaacatcggcaatgggtaaaaggattttcacttttatttgctgaaattgtatttttagtttggttctttttaagtggaattcattcaattgctggattaaggaacttaggtgcaataaagagtaaacgcgttgtatttgataaagcacagggagtatatgttactcaacaaccagataattctgttttaattcttttatttggtattctggctttattcattgttgctggttttatatatctatatatcattaatttgaaatctaataagcatactttcttattagaaaagagacatgaacatattccaactaaccgtgaagaaattgcatctttgtttgatcaaagattgcatgcaactttgatgacaattccaattgttttaatcattttatttacagttttgccaacagtattcatgatttcaatggcatttactaactatgatcgtcaacactcagttgggattttcctggactggttttcaagcatttggaaacgtgttaagtggtgatttagcaggtaccttcttcccagttttaggttggaccttaatttgggctgttgctgctacagctactactttcttctttggtgtcttattagctcttttgattgaatcaaagggaattaagcataagaatctatggagaacaattttcgtaattgtttatgctgtaccacaatttgtttctttattaatgatggcgcaattccttgactatcaaggaccattaaacaccttacttatgaattggggatggattagccacccaattcacttcattgataaccaggctagtcctcttgttgctcgaattacagttattgtggttaatatgtggattggtatcccagtttcaatgttaacttcaacagccattattcaaaacttaccacaagatcaaattgaagctgctcgtattgacggggcaagtccagtacaaattttcaaccacattacattccctcaaattttattcgtaatgtctccagctttgattcaacaatttattggtaacatcaacaacttcaatgttatctacttgttgactggtggtgcaccaatgaacaataactacaatggtgctggttcaacagacttgcttgtaacttggctatataacttgacatttggtcaagaacaacgctataacgcatcagctgttttgggtatcttgatctttatcattagtgctacattctcactaattgcatatcgtcatactaacgcatacaaggagggctaaaaatgaagtcttatcgtaaccaaagaagaattgctttaatttttagatatgttctattagccatcctgggtgttttatggatattcccaattatttggatcattttagcaagtttttcatacaataatacaggatttgtatctacaatttggccagaaaaatttacttggcaaaattatgtcggtattcttactagttcacaatatccatttataaactgggtattaaataccttatttgttgctgttatttcagcaactctatcaactttcgtaactattggagttgcttacgtattatcaagattacgcttccgcttccgtaagccatttttacaaattgctttggtattagggatgttcccaggtttcatgtcaatgattgccttgtactacattttaaaggcattaaacatgttaaaccttggtggattgatcttagtttatgttggtggtgctggccttggcttctacattgctaaaggtttctttgatactatgccacgagcaattgatgaagctgctgaaattgacggcgctacgaaatggcaagtattcattcatattggattaccactttcaaagccaatgattgtttatactgcgcttacttcattcatggcaccatgggtagacttcattttctcaggtatcatcctctctacctcaggaaatccgaagacctacactgttgcctatggactatacaacatggttcactcggcaaagggtacgatggctcaattctttactcagttcattgccggatgtgtaatcattgcgatcccaattacaattttgttcattgtaatgcaaaaattctatgttaatggaatcacagcaggtgctgataaaggttaatcaaattaaagtttatgtgaaaaaagtgtcctgtcttaacagggcacttttttatttgtttgaaggagaaaaaatatgacaccttggtggaaaaaagctgttgtttatcaagtttatcctaagtcatttcaagatagtaatggtgatggaattggagatatccccggaatcatttcacggctggggtatctagaaaaactgggaattgatgctatttggctgtcgcctgtttacttatcccctggtgtagataatggctatgatatctctgattatcaaaaaatagacccacaatacggaacaatggctgacatggataatctgattagagaagctaaaaaacatcatatacgcattattatggaccttgtcgttaaccatacatctgaccagcatccttggttcattgaagcaagaaaaagtaaggagaatccatacagagatttctatatttggcatgatccggtagagggccatgaacctaatgagttgaaatctgctttttctggttcagcttggaagtttgatgaaaaaactggtcaatattacttacacttcttcgccgatcaacaaccagatcttaattggaagaacccaaaattaagaaataaaatctatgaaatgatgaattattggatcgataagggaattggcggctttaggatggatgtgattgaacttattggaaaagatcccgataaaaagattcgcgagaatggtccaatgcttcatccatatttaaaagagatgaatgagaatacttttgccggtaaagaattaatgacggtgggtgaaacatggaactctactccaaagattgctgcagaatattcagatccagctcgtcatgaattatcgatggtatttcaatttgaaaatcaaggcttagatcagcaagaaggaaaagaaaaatgggatttacgtccgcttgatttaggcgaattgaaaaaagttctagttaaatggcagacagaaattgattttaatcatgcatggaatagtcttttttgtgaaaatcatgatattccgcgagttatttcacgatggggaaatgacaaagaatatcgagttcaaagcgcaaaaatgtttgcgattgtactgcatttaatgcacggaacaccttatatctataatggtgaagaaattgggatgacgaattgtcctgttaagtcaattgatgaagtagaggacattgaaagtatcaatatgtaccgcgaaagaattgataagggctacagtaaggatgaactaattaaagcaattaatactaaaggtcgagataatgcacgccgtccaatgcagtggtcaaatggagaaaatgctgactttactacaggaacaccgtggctaaaattaaacccaaactacaagaccattaacgttaaagaagccttagaagatccaaattctattttttatacctatcaaaaattaattaaacttcgccatgaaaattctgttgtggtggatggagattttgaacttgttgaaaatactagtgataatattttggccttttggcgaaaactagaagatgaaaactggctagtagtcgctaacttgtctggtgaggaccaaaatctaaatttagatattccctttaaagaagttttgattagtaactatgaaaaacgagacagtttaaaagatatggttttaaaaccttatgaagcttttgcagttaaggcatagtaaaagacgcattgaattttatcaatgcgtctttaatttatttctttttatttggacgtcgtaagtagcgtaaagtattatttcgaatatatttttgaaattcttgataaattggatcaaaaatttgaggttcatcagtttctttaaccattacttttggaaagaagaaacgctcatctccttggagagttccatttaaggatttaacgagtgggctcaattcagacagttcgactaagctaccatcagcttgcatgatttcaattggactgtgagcattttttccagttggcttatatgcgtcatatggctcatcaaaagctgaattagtagcagtatagtagttaggatcaaacccagcttgtttaatgagattctttagttttggcagtaaactcttagtatcttcattaattttgacactttcaaggggatgacggtataagtaacgatttgaaagatcagataaaatttgatcccctgagttggtccagagtaagaaattagtttccattacgccatcatctaacttaaggtaatcttcaagagtccattttccgtttaaaaatgcttctagttgaggagtaacttgaagtttgccttcttcatagatgatttgagctctttcaagtaagtgatgtaagataacttccattgaacgattgacacggtgaaagtaaacttgttgatacatttggtaacggctaataatgtaatcttcgactgagtgaattcctttatctgtaaagcagatgccatcacgatatggacggattacttctaaaattctagttaaatcaaagcttccgtaagtaacaccagtgaaataagcgtcgcgtaataaataatccattctatctgcgtccgcttgacttgaaattagtttgactacctgaggattagggtaggttttagcaataacactagccactaattctggaaaattaggacttacttttcttaaagcttgattaacttcagtatttttatcggtaataatctgttggcccattttttcatgattagtaccaaataggtgctcaaaagtatgagaataagggccatgaccgatatcatgaagtaaagctgcacattctgctaagagtctttcatctggattccataatccatcgcctggctctttacttacatacttttcttcaaaaatatcacaaattcttctggtcaattcataaacacctaggttatgttcaaaacgagtatgagttgctccttgaaaaacgtaagatgccggtcctaattgcttaattcggcgtaaacgttggaattcttttgaattaatgatatctaaaataacttgatctttaacatgaatataattgtgaactggatctcttaatactttttcatgatccagctttttactttgaaatttttccatttttcttatactattttctcggataataaaataaatttgctaacgtataatcaatttgattataacaataatgctactttaaggctatcttggcgtgaatgaaggtgaaaatatgaccaaggaagttgaaattaaaattactagtaaaattcatcaggaagatgaatcagccgtttttgaaagagatggcttaggatcaattgaaaaagttggcgaagattggcgcataaaatatagcgaaaaaaataaagagggcgatgttgaagtaaaattattaattaagccaaatgaacttgtaatgcaacgaggagacgctaaaggtgatcatacgctaatgaaatttgagccaggagaaaaaagaaaatgcaaggttgtagcttctggtaagcaaatgaatttagagtctttgactaataaattgaatttttctgaaatttctccaggaaagatgcaactaaaagttgaatatgatctcttttctggtctatacttagtaggtaactatgcaataaagattgatataatagaatagatctttagcaaatttagataaattgattacgtgaaaggacgtgccactgtggggttagatgattttcaaggccaaaataaagacgaattgtcaatgatcgaagttgctcgtgcaattttacaagatagcggcaagcgaatggcctttgctgatatcgttaacgccgtccagaactttctgggtaagagtgacgaagaaattcgtgagcgtttgccacaattttacactgatatgaacactgatggtgaattcatttcaatgggtcataatgtttgggcattgcgttcttggttcccatatgaatctgttgatgaagaagtaaaccatccagaagatgaagaagatgtaccacgtaagaaacaccacaagaaagttaatgctttcattggtgattctgacgatgatgatattatcgactacgattcagatgatccagaagatgaagatttggatgttgacgaagaagatactaatgaagacgactactcagatgatgatcttgatgatgccgatgacaatgaattagatgatggtattgaaggccaattatctgaacttcatcaagatgatcttgatgacgatgatgagtaaagtacttgacggaaagtaattttccctttagtattttgtatgggcactctatgtgcaattaagctcccatgtatttgggagctttttttgattttaacagagaataaaagaaaagagaggaagcacggcatgacaaagtatatttttgtgactggtggagttgtttcatcactaggtaaggggatttcagcttcaagtttaggacgtttacttaaaaatcgtggcttaaaagttaccatgcaaaagtttgatccttacattaatatcgatccaggtacaatgaatccatatcaacatggggaagtttatgttaccgatgatggtacagaagctgaccttgacttgggtcactatgaaagaattgttgatgttagaacaagtaaatattctaatgttactactggtaaaatttatcaagaagtgcttgataaagaacgtcgcggtgactatcatggtgcaactgtgcaagtaattccacatattacggacatgattaagaaaaaaatcatgcgtgctgccttaacaactgattcagatgtcattatttctgaaattggtggtaccgtaggtgatatcgagtctactccatttatggaagcaattcgccaaatgcgtcgtgaagttggtgaagaaaatgtaatgtacattcactgtaccctagtaccttatcttcatgctgctcacgaaatgaaaactaagccaacgcaacattcagttgctgaacttagaagtattggtattcaaccaaatatgcttgttttaagagctgagaaaccaattgctcaagagttaaaaaataagatttctacctttactgatgttccagtagaccgcattattgaatctattgatgctccttcactttttgatttaccacttgcttttcaagctcaaggtatggatcaaaaggtttgcgactttttacacttggagagtccaaagccagaagcagatatggaagcttggaagaaattagatgaacgtgcaaagaacttaaagaacgaaactactattaccttagtaggtaagtatgtagaacttgaagatgcatatatttctgttactgatgcattgcaacacgctggctacttatatgacactaaaattaaggtaaataaggttcaagcagaagacattactgaagacaatattgcagaaattatgaaggattcagatggattaattgtacctggtggttttggtacacgtggtcttgaaggtatgattacttcaattaaatatgcccgtgaacacgatatcccatttttaggaatctgcttaggtatgcaaatggcaagcgttgaatttgccagaaatgtacttggcttaaaagatgctaatagtgcagaagctaatccagacactaagaataatattattgatattatggctgacaagcgtgatgaagagaatattggtggtacgcttcgtttaggtctatacccagcaactttaaagaagggtactaagacacgtgaagcatatgatgaccaagatgtaattcaagaaagacaccgtcaccgttatgaattcaataatgaatatcgtgaagcatttgaaaaggcaggcatggtcttctctggtgtttccccagataatcatttagtagaaattattgaaattccaaataaaaaattctttatcgcagctcaatatcatccagaatttttaagtcgtccacaaagaccagaaggattgtttaaagcatttattggtgcagcaagtggtcttccagcacaacattttaactagactttaaaaattaaatttcggtaacaagagagccataatcctcggcttctcttgttttttttgcgtttttcatttaatatattttgtgatacatttgggtattacaaatagagaaaaggattgtttccccaatgaaacagatgattattcatggtggaaagcccctgaagggcgacgtatggatcggcggtgctaagaattccactgtagcattgattccagcgtcaatactttcgcggactcctgttaccctagaaggggttccgcgaattgctgatgtagataatttgatggatctacttagtgaaatggatgtaaagtgtgattttcatgaaactactttacgaataaatccggataacattaagcgtagtccccttccagcaggaaagattaagagcttgagagcttcttactactttatgggtgcattattaggtcgctttggtaaagctgtggtgggctttccaggcggagatgatattggccctcgtcctattgatcagcatattaaaggctttgaagcattaggtgcaactgttgagaataaaaacgatcaaattatcattacagctcctaaaactgggcttcgtggtgcaaaaattcatttaaagatgccttctgtaggcgcaacgatgaatataattatggctagtgtaatggcaaagggccaaactattattgaaaatgctgctaaggaaccggaaattattgatttagctacatttttgaataatatgggcgccgttattcgtggtgcaggtactgaagtgattcgaattgaaggagtagaggaattaaaagcacaaactcctcatactattattcctgatcgaattgaggctggaacatatgtagctctagctgcttgcatcggaaatggtattagaattcataatattatcgaagaacacctagattcttacttggctaaagtagaagaaatgggtgtagtaattgatgctgatgaagattcactttatgtttatccagcaggtgacttgaaaatgattcaagttagaactgatgtatatcctggatttgcgactgatttacagcagccaattactccacttcttctaacagctaagagcggtgaaggcgtagtaattgatcaaatatatcctaagcgtgttggtcatattcctgaacttcagaagatgggtgcaaatattcaggtagaagataatattatcttagttcatccaactcatcatttgcatggagcacatgttagtgctggtgaaattagagcaggcgcttgtttgatgcttgctggcttaatggcagatggtgaaactatcatttcaaatgcaggaaacattttgcgtggctatgatagaattgaacaaaagttgcgtcaactaggtgcagaggtatctgtgattgatgtttaattaaaatagaacattaaaaaagggcttggaatctccaagtccttttttattggttttaagaattttattggttttaagaaaatatttttatttagctttgtacttcaattttttctggggcagcaggaatatgttgctcttctaagccagattttcctttaaatagtaaattgagaatcgtagcacttaagcttgctacaacaataccatttccaaggaataattgaatagtttctggtaaagcttggaaaacttgtggataaacagtaacacctaatccgagaccaattgaaatagctacgattaggatattacgagtatcctcaaagtctactctcttcagcattctcattccctggacggcaatcattgtaaacatcacaagcatagcgccgcctaagacagagtcagggatgatagttactagagcaccaaatttagggagtagtcccattaacattaaaaatcctgatgcccagtaaattggtctttttgtagtaatacctgataattcaagtaaacctacattttgtgaaaaagtagtgtaggggaatgtattaaagattccaccaaggatctgtgcgagcccttcagcacgatagccttttttgaggtcatcgctagtgatgtctttgtggagtaaatcgccaatagcaaagaatactccggtagattctaccattgaaacgagagcaatgataatcattgttaaactggatgaccactcaaactgtggcattccaaagtaaaaaggttgaggtaagtggaaccaagaagcttgagcaactggagtaagtgaaaccatacccagagtactggcaattaaggttcctgcaattaatcccactaaaacagcgatggatttgataaatcctttgccccaaacttgaagggcaagaataattgctacagttataaagccagttaaaagatttttaggatcaccgaagtttttagctgtagaattgcccccaccaagattttgaatagaaaccggaattaaggaaagtccaattactgtaattaagcttcccgttacaactggtggaaagagctttttgattttagaaaaatagcctgctactaaaaatacgaaaacacccgctacgatgattgcaccatacatagtaccgatggtgaattttttcccaatcatttgaagaggagctacagcttgaatagcacaccctaaaacaacaggtaagccaattccaaaataacgattacgtagaagctggagagcagttgctaaaccacacatgaagatatcgattgaaactagataagtcatttgagtggagttgaattttaaggcagttccaattaaaagaggaacggcaattgctcccgaatacattgcgagtaggtgttgcaagcctagtaaagcagcttttttgtggttaacttgtgtgtgcttcatttattcttctcctacaaaatgcacttgattgttttcaaaatcagaaattctagctaaggcttcaagactgtagccgtgatctttaacccattcgctgccaccttggaattctttagctacaactacaccaacaccagctacagttgcatttgcttgatctgcaatattaagcatccctttaacagcttctccatgggctaagaagtcatcaataattaataagtgatcgtcactactcaagaatttcttttcaacacaaattttattattaacttttttagtgtaagaaaatacgtctgcccaataaacagcatcattaagagttgaaggttttttctttctcgcaaaaaccattggcactcctaattgatatgcagccataataccaggagcaattcctgaagcttcacaagtaagaactttagtaattttttcgttttcgaataaacgcttaaattccttaccgacttccatcataagttgcggatctacttgatgatttagaaaagagttaatttttaaaacattgccatctaatacttctccatctttacgaatccgttcctcaagtaatttcaattttatcctcctgcaaaaaaagacttcttctacccgtaaattagggtaaaagaagtcctttgtagtgctacttatgacatcgattacctatagtccagaattaattggttccgggtagaaactgtcgaccttattacgacgatatatagatatttgatatctagagtgtagcagaatcattttccgaacacaaggcctcttttttgatgtattattctgaaattgattttttcttttttaaagaaaggattgcctcaagaattccatatgtaattccagcaagtggccaaataatccagctttggctccaattcttgctaatgaaactataagcaagatagataaaagaaatagtcatccaataaatagtggcatatttttcaattatttttttgctggcctttttctcagcagtatagtcttctatttgtaaaataatattaaaactatcacgaacaatattggttttgactaagaaaaagacaccaattcctacaagaaaaatcgtagcagttgaaagaccagtcattaggtcatcaattcggctatttgaaagagaaccaataaataaagagccagtcataagtggaatagcagataaaatacaaaaagtaatgccaataatctttagaactaggtgctgattttcatattctttacttaacttaagaacttgctcttttgtttcttcagaaagattacattcttcatactcaaaattttcgtgaacttttagccagtgatttcctgcaataaagagagccacagcggctgcaactagaagtattagaacaattacgccaattcctgttacaaaattaatcgatgaagctaagatatctaatcttgttaagctgattaagattaataaagtaattggtgagaaaatacatagcatgacgccaatagcaatcaacgtagaactgcgcttcctagcagataagaaatcgtgaaccgaagattgagataagcattttgtttgagacataggtatcacctcttttgtatataaaaattgaatagtatagatttacttcaattttatataacaaattattaaagcgctattttgatgcttgtgaagttaaaaaataaattaatgattgaccaattgaatttttcttagtaaagtttctagtaaatagggataaattattttttagaaggagaaaattgtggctaagactaatctaaatgattttgacaagattattgtgcttgattttggtagtcaatataaccaattgattactcgtcgaattcgtgactttggtatctattcagaacttttaccacatgacttaagtattgaaaagatcaaagaaatggcccctaagggaattatcttttccggtggtccaaacagtgtttacgataagggtgctttaaaagttgatcctgaaattttcaagcttggtattccaattttggggatttgttatgggatgcaactcatgagttacgatttaggcggtaaggttgaaaaggctgataattccgaatatggtcgtgctgatattgaggtaattgatcctaatgcagttttatttgagggcttgccaagagaacaatacgtttggatgagtcatggtgacttagtaactaaggctccagaaggctttactataactgctaagagtaagaattgtccaatttctgcaattgctaacgacgagaagaagttctatggaattcaattccatgccgaagttcgtaattccgaatatggtttagatattttgaagaactttgcatttaaggtttgtggtgccaaagctaactggaccatggatgactttatcgagatgcaagttgatgaaattcgtaaaaaagttggcgataagaaggttatcttaggcctttctggtggggtcgattctagtgttactgcaactcttcttcacaaggcaattggcgatcagttaactgcgatttttgttgatcacgggatgcttcgtaaagatgaaggcgatcaagtaatgcaagctttgaataaggatcttggggttaatattattcgcgtgaatgcccaagagcgtttcttgaataagctcaagggagtaactgatcctgaacaaaaacgtaagatcatcggtaaagaattcattgaagtcttcaacgaagaagctaaaaagttaaaggatgttgacttcttagcccaaggtactttatatactgatgttattgagtccggaactaatactgctcaaactattaagtcacaccacaatgttggtggccttcctgaggacatgcactttgaattaattgaaccacttcgtaaacttttcaaggatgaagttcgtgaacttggtgaaaagctcggtattcctcatgatttggtatggcgtcaaccattcccaggtccaggtcttggtattcgtgttattggtgaagttactgaagacaagcttaagattgtgcgtgaatcagatgcgattttacgtgaagaaatcaagaatgctggtcttcaagaagatatttggcaatacttcacggttcttccaggtattcgctcagttggggttatgggagatgggcgtacttacgactacactatcggtattcgtgccgtaacttcaattgatggtatgactgctgattttgcccaaattccatgggatgttttgagcaagatttctactagaattgtagatgaatgtgaccacattaaccgcgtagtttacgatattaccagtaagccaccttccactattgaatgggaataagctgacaatgttagttgataaggaaatcctgatttgacagcatttaacgaaggcaaaacttagacaaaataataaaaaatggtttggttgtctgccaaaagtctgccaaattatataggctcttagtataaactaagggtcttttttgatgtagagacaaagcaagtttataactgaattgtaaatataagttaacgttttaagagctgtataattattaatttgtaatttaaatataatatggtatcatatagatgaatgtctatgtattaaggagatataaatggattaccaagaattagcaaacttattaaaagtcgttgcagaacctaaccgacttaagatcttaaacttactttcatgcggagagatgtgtgcttgtgatattcttgatcatttcaattttacacagcctactctttcacatcatatgaaagtattggaagataagggattgatcttagtgcagaagaggggtaaatggcactattattcattaaacccagaaaaatcaacagtaattattaatggattaactgaagtactatcaaattctgagaattgtatttgtaaggatgcttaaaaagtttgttaatccttttattttgaataatacatagatgattatctatatatagagggagttttttattattatgaatacgtcaaaaggcttatctttcatggatcgctatatgactttatgggtatttctagctatggctttaggaattgtgattagttttgtctttccatcattccctaagttaattaacagttggtcagtgggtactacttcaatacctattgcgattggtttgatcttaatgctgtatccacctttgacaaaggttaattacgataaaatgggggatgtttttagagataagaaagagcttgttttttctttgattcaaaactggattgttggtccacttttgatgttcgctttagccgttattttccttcatgattatcctgactacatggttggtttaattatgattggattggcaagatgtattgccatggtaattgtgtggaatgaattggcacaggggaataatgattatgcagccggtttggtcgcagtaaattctattttccaaattgtcttttattccgtttacgcatatgtttttattagtgtattgcctaaattcttcggcattcaaactcatgcacttaacgttacgatgggcgaaattgctaaaaccgtctttatttacttgggtattccgtttattttaggaatcggttcacgctatttgattattaaatccaagggcaaagattggtttgaagctaagtatgttcctaaaattagcagaataaccacctgggctttgctttttactatcgtactaatgttttcggttaagggcgttaaagttgttcaattgccgcttgatgcagttagggtagctgttcctttattactatacttcgtattaatgttcctaattactttttggattgcgaaaaagacacgcacaagctattcaatctccgtaacacaagcctttactgcttcaagcaataactttgaacttgcagtggctgtagccgttggtatttttggcttaaactcaagtgaagcatttgcggccgtaatcggtcccatggtagaagtaccggttatgatcctattggtagatgtggcactttggataaagaggagatactacaagtaatgaagaaaatatattttttatgtactggtaattcctgtcgtagtcagatggcagagggctatggcaagatcctgttaaaggataaatatgaagtgaaaagtgcaggtattgaaaaacatgggttaaatccatatgcggttaaggctatggcagaagatggcgttgatattagtcagcaaaaatctaagttaattgatccagattatttgaattcagctgatcttgtggttaccttgtgtggggatgcaagagatcgttgtccagccttgtcgcctcaaacgaaaaatcttcattggcctttgattgatccgacgcaagcacaaggaacacctgaacagaaaatggtaatatttcgtcaagttcgtgatgaaatcaaaaagcgtgtagccgatttgaaatgaaaaatattaagaaattttaaagaagaaattttgaaattgatagcaaacttaagaaatggtataaattaactataagtatttaaaggttttattttatttttaaaggtatatttttttattactcatggtgatgtaagtactattacattgcgccaacatggtgtgtatagtgtcattatgagagatgttggataagtcgtagaacaatgttaccgttgctacaggtctatgactgattttttatagaaaatgtagcgataccaccgtgggcgccacgctagcggatactggtagtagcgtggtttagttatttttaagttttaaaggaatttttaactttttaacttctccagcactagcggtctgcccatttgatggaaaactgaatagataatgacgagaagcatgtgtttacaaacacgtgcttcttttagttatcgcggattatcaaggtgttagagaaggctttaacattggtaatccgctttttttgtcgtcaattttagttaaagggatgccatatcccgctgtctcaatttaggaggttataaattggctcaaactaataacaatcaatcagttgaaactattaaggaatcaacttttgcagcttcagtgttgcccaaggctacaccaattgcaaatgtacttcaaaagccattgaagttagctacgggtagtatctttaaggtgctttctggtacaaatgaagatgttaaggatagtaacggtgataacactgtacgtgcatgttatcgagttcagtcattacgcaccgtattttgatttagcaaaagagagctctagttggatgcgcatagaaggtgaatttaggcataaagcggcacatgcaattctctcagatttaaaagataaagatgaagaagaattaggtcaaaaactaatcggttacgtggttaatcaatggctgttaacagacaaaagcaaaaacttaatcccattatggcaaaagttaactgacttggctaatggttcaggtgctattcctccgcttgctccaatgttaacagatcgactagttcaagagattaagtggtttttgaccggtggagcagcaggtgtattttatcgtgtttttcagttatttggtgaggttggtaaaggtgattttctcctgcttatgttcgactacgttgaaaagccgaatgaaaaagagcattttaccattccgggtaatatgagtaaggatttggagctgattcaaaaacagcatcctaatatagaaacgattaattactatcttaaacgtgctgtcaaggagattgaggaagaaaaaaagactagtcaaaccgaccaaagtaaagactagcctatataaagcgaacaaaccaatgcgacggctgttcgcttttcattatcttccattttgaagtttttgaaaaggaaaagactattatgaaagaattagtagattttacagacttagtaaatatgggatataagcctagtcaggctagaaccattattagaatcgcaaaaaataatatggtaaaagctggttatggcttgtacaataataagcgtctgggtatagtcccagttaaggctgttgaacaaattacaggattatcccttcacaaaagaaaggatgatcggtaaatgccggttagtaaaactaaatatgctgacgtttacaaagatgataaaggacacttcttttatcaaatctttctaggcagggatgccaaaggaaagaagcatttcaaaaagggtagaaaagatgaactgaagcactattttactagtgctagggcagcacatattgaagcacaaagggttaagcaaatttacttaaacgtcaatttaggtgatataacttacgcgagcttcataaaagaaaagttcttaccaaagtacaaagctgacgttgaaggcagtacttacgaaacacattcaaaaatgtttttgcatgccgtggactttttgggtaatgtaacccttaaaaaacttacagtagaagaatgtgagaggtataggacttagctgttaacagaagctaagtactctcaaagttatgctagtgtagtgtatacggcctttaggcaaagcctggattacgcagtagaaattaatttaattcctgcaaatccttctctgaagacgaaatctgtgcctaaaggcaacgctacggctaagtattggacgaaggaagaatttgaaaaagttctttcgtctgtatctgtttctagtttttatgagcgtttaatttatgtaacgttcttgttcttttataggatgggatgcagagtctctgaagcaggtgcattaagatggtctgacgttgatttaaacaatggtaaggtaagatttattaataacctccactataagaataagatggaatatgagctagtgctatatttgaaaaatgattcaagtcggagaactttaactcttgatgatgaacttgttagagttttagaagattggaaaaaagaacagcttaagtatagtgttcatgattttgtcttgtcctatgacaattgtccattgaataaatcaaccttaagcaaatggcttaaacgctattccaaaattgctggtgttcctagagttgacggtagaggattgaggcattctaatgcttcttatcttattgctgaactaggtgcggatgttttaacggttagtcaccgtttagggcataaaacacctatgacgacactgaaatactatgcgcatatgtttagtaacaatgacattgagttagcctctaagatggaaggaagcatggatatttctcctgcagaaaaatcaaaagttacatttaatggtaaccaacatttagatggaaacaaaatagacggtctgccaaatgtctgccagaagaagaaaaaggctagttaattagttgatataaaaggaacgtcgtttattctaagggaataagagactcatctctgaaaaaagaatataaatgaaaaaagcctattaaatcttggtattgatgaaccatgatttaataggctttttatagtatttaattaaactcaagcttatttgcttcatcgatcttagttaggaaagatgaaacatcagtaataatgtcattggtgtatgaaacattaatcagattaacccaattttttcgaagaaaatagtcgtcaatgtcgtatctaactttagttaagtatttataactaataaatagtaattcagaaaaaatcaaattacgtttttgaggctgcataacgaaatccagtaatagatcttttccagcacccttaataaagtgaaaaaattcgcaattgatatgtctaatcggatgaaaaggatataaaatttgagaatttaatacttgtttttcaaattgtctaagtaatttttgatcttttttactaatttgataatcattgttgtttaaattaatcatcgtatatcaattcctgttctaactgttacctaaagtatataaagtgaaaaaagtaaaaacaatgaatgttaactaagttgaaaaagaaaaactttttatatcgaaagtaaaaaattattttacttttgatataatatttttaataattaagtaaaagaaagttacagactataaatatttacggaagagaagtgaggaacaagtttgagtgatattagggtacagaatacaaaaaataatttgattgctgctcttttgagctgcttagaagatgagagtttccataagctaaaagtaaaagatattattgataaggctggcgtaagtactagaacgttttatcaatattattcagatgtcaatgatttactaagagatacagaagatagctttattacagagtatctaaaaaatgttgaaaaagatcgtgattcattaggagatcttgatttagatacaccttttgaagatcagttagaaaatattttaaatgcaacaaaaaataccattgagttttgttatgcacataaaaaagaaatacaagtcttgttatcggataatggagatacgcgtttttataatatgattttccagactggttgtgaggaaattatgaagcgtatgagccagatgaaaaatatcgataagttaaagatgaatgaaaaagaacagatgagaatgatgattagtgtacaggtatttgtacatagtatcattggcatggtaagagttttgcttgaatacagcgataggttagctccatatgacgttcgtcaaagtatacttacatttttacgtgagtcaccggtagcttccatgaatataaataaaaaatagagacaacaaaataatttatagtatattaggctgaactccacgataactggctaaagtattgaattaagtggttttgttggcaattgagaaataattgtacttaaatatgaagtagcataagaagaatagtaattaaaaacgaagttttagggatacgtcaatgaaaatagaaattccaactatgaatggatttattccagattgctacagtaaatttgctaatgaagatcaaaaaattgaagggaagcctagtagatctttcccaatttttattactgatgcacctgataaggcaaaaactttagctatatattttagagattttgattcagttccagtctgtggatttacatggattcactggttagctgccaatcttccggttcgagatgttccagctaatattagtcattctaagaatagcagccttgattttgttcaaggaaataatagtaatattagcaagtttttaggtgaaaattctggcccagttgaaggctatacaggtccgatgcctcctgataagacgcactattacaccttaaccgtatatgcattagacacaaaacttgatctaaaagatggctattggttaaacgactttttgcgtaaaatggaaagtcatataattgatagtgcgactatttcagttccaagtagagcaaaataaaagtcgaagttactaataaatatgctataatttaagtaaagaaaaaggagatccgaggatctcccagacagcccgctttaagagcggtgacaaaattatagttttggcaaacgcctactcaataactcggtcaaaagttatatattgagcggcgttttttattttttgttgtggttgtcgatatatgttagcaatgctaacacaaaagtaccaaacaacagcattaacgagatgacctcgtatacgctcatctggctgaaccctttccaattgatgtcggtccataggcctcacctccgggaggaaaaacagcccccgctcataaaactttctgcggatataattataacgaaaatttatttgcaacagaatatagattagttaaaaagctcgcgattaatttcgcgggcttttactattaaacttattctgctttttccttaataaaaaaatatgtaaatagacaatagattataattcctaaataaaaaacatttgtagaactaaaagcaggttcaataaatctactaacaatgtagtctatacctaaaatacaaaaaatatagatccagctcccgtaaacaaataacttgtgtaagttagatggtagatgctttctgtatttaactaaaagagaaagataacgaagttgcactatataagatataaagaaatatgcggctccactgaaaattgaaaaagttattccccaggcaataagagagactgtgccgttagagttgctgagtccactaattactgggccaataatacctaagactgctaggatacaggataaaactaaatatttatcattagtatgatgaaaggattggataacagaccttaatttctttttctcttccataatgtcaaagttttgtttatttagatgcttaaattcacgcataataagaaaactataaattagaagaccaaacgaaattgcaagaactacaatggttgcagcaaatccaataagtgaaatgattaattgcattttatcactgacacctattaggaatcctgaaatagcactgcaaaaactaatacatgctggactgaaaatagcgagagcgattgatagagcgcgtaattttgaacttttcttagcagtagagagatacttttgaaccaatttatcaggtaaaataggtgatttatcttctgcgggaatatctgctgttttaatttcaaaagatggagcaccactttttagtaaataatctgtggtgacgccaaataattctgataagctaacgattttttcaatatctggaattgattgatcactttcccattttgaaacggcttggcgactaacattcattttttcagctaagccttcttgagaaagattattcttttttcgtaattccgtgattttttgacctaatctcatatggattgtcctttcattgttgattgattttaatttattaaaaatcatggttgcagacaaccactttttgattgcattgtgggcaactaatggttgcgagaggaaaaattatagtgattaatcttagttaagtaagctattctctgcttttgtgtagaatttgtgacaccgccaaaatgaatccaatgtcgatgttgcattcctaattgctttagagttttgttaacaaaaattcgtttaataccatttcccaaaaagagtttgacataaaaagttggtgaagttgaagtggtgaggacataggtatgtttaatgttggttaattcgccatgaataccagttttgcttacagtatgggataatccttttccttctttcataactttgtcaataaagcctttaagcattgccgggatactattccaccaaagtggagtaataaaaattattgcggaagcttctcttaagtaatttaagtattttgttactagaggatcatgagttttaccagtatgaaataaacgtaattcttctttgtcataaataggattaaattgttcttgatacaagtcaattactttaaagcttttatgcttatgtgctaaatttgattttactgattctaaaattgcatggttaaaacttttttcataaggatgacaatagatgattaagaaatccattttaatcttttcctttcaaaagttgatttaaagtgtattccactaattgtgcgtcatagcgagtaattttatttttaattagtaatgcatatccttgaataaaggaccagatttgaataaataaatcttgatcagaaagagtagttgatgaattaagattagtaattaagttttttactttgttcaaaaagggatattgattagcatttgaatataaatctagtgctgataattggtagaataagaagtccatttggttgggatgcatagttatagactgacaaatatatttagcgataatgagtaactgttgtttagatgaataatcttcatttaatgggatctgctcaataaatcgtttagataattggattactactttttgaaatagttcatttttatctttgaaatgtctataaaaagcccctgttgtaagtcccagttcctttgtaagtttgcgtaaacttaagttttgatacccattagtgtcgattagatgaacggtttgatttataattttttcttcggttgtcatttttatcttctttcttgataacggtgttatctttttgggtctatgataacactgttattatgacaataaaagataaataatttgttataatacacgctaaggaaagtaaaaacacaattcggttggtagtccgaatgtatgatttattcatatcagtaaccttccctcctaggatgtccctctttcctcttatttttaggagggtacatagtgattaaaggtgtattaactattatttttgatgaaccattctacaaagcaatttttgagcaatttgatggtactgaatataaagtagctcaagttaatatgggaacatcattgccaacgatgccaaaaataattaacttggtgaatgagcattattctgacttacgatttagcaaatcaactcgagatcaggaagtaatgcatcatattaacccgaaaagagctcaaagattagcgcataaagaagttcgaaaacgtggaattggtactaaagctcaacaagctttaaaaaagcaatttgagaaatcgaaaataactagaaaaaagatgaataaagatagaaagcgtgaaatgcaaaaagagcgttttttacaaaaacaaattaaacgtcgaaaaaaacatcgaggtcattaataaacaaaagctcgcaattaatttgcgggcttttgttgataaatatgctataatttagataaagaaaaaaggagatccgaagatctcccagacagcccgctttaagagcggtggctaaagttataaagttgacatgcgcctactcaataaacctgccaaagttatgaattgagcggcgtttttgtttattttttgttgtgatgatcgatatatgttagcaaagctaacataaaagtaccaaacaacagcattaacgagatggcctcgtatacgctcatctggctgaaccctttctgcttgatgttggtccataggcctcacctccaggaggtaaaacagccaccgctcataaaactttctgcggatataattatagcgaaaatttgtttgcaaaagaatatagattagtcaaaaagctcgcgattaatttcgtgggcttttaccataattatattcaaaaactagttctctttgaaaagtatcatcgtaagtagctgatactaaactatagtaaaattattgatatgatagagttaaaagagaaaacttatttggagtaaggtggaggaatttttgaaagataaaaaaattctaaaaagaattaattattgggttacaattggaatagttttaataatatgtataggtatttttacatggtggaataattctaaaaagaaaactccacatcataaattgaagcctcaacctgctttaattgacaacactagtactcgtccagcttcatatacaactaaagaattcaaaaatttattatcccaaaattatccagatatttataaaaacttgaattttaagcaaaaaccaactttctatgtgattcctggtttgattcagtcagcagcaattaaatatactcctcctggtcagggacaaccagggattgcatatgatatggatccacaaggcttagcgattattgaccataaatatttgattatttcagcgtatagtaaaagcaagacctttgattcagttctttgggtattagattttaagactggccgttttgtaaaaacaattgccttaaataatattgatcatgttgggggaattacttatgacgaagatcataagcgtctatgggtagccactattaatcaagagcaacgagctcaagttcaatctgtaacgctgaaagaaattgaaaaatataattttaagaaacagaaaaagccaataaaatttgagcatggtactaacttatcagcgccacttcgaacatcttatatgacttatcataagaaaaaactctatatcggctactttgataaggtcgaaggtggtcagctgtttgcctataaacttaataaaaaaggactatttaaaaaagataaaatgcaagatggtctagctattcctagcgaaaactggtcaacttattctcaaattcaaggaattagttttgataaaaatgatattttactatctacttcatatggtgatttaaattcccagctattaatctttaaaaataaactgaataagccaaactataatcttgatctttctgaagcagataaaaccattattttgcctccatatatggaacaaattattggtaaagatggtgaaatttatatgttatttgaatcagctacagcattttatcgtcaaaatcctaatttactgcatatggatcgggtaattaagttaaaagttaaattcaagggttccgaaaatagtaaggaatagctatcaagaggaataaatataaacatatattgaaaattaaaactcacaattaaatttgtgagtttttttatgttctaaatttagccgttcatgtctttacttttgccgcttattaaaaatgacgatacagttccgacttatttaagtattctttagttaaatcaaataaaggaagtaatcacatgcttattgaaacttatagtttaactaaaaaatatggcaaaaaattagctttgaataaggttaatctcaaaattgatcgaggtcaattggttgcctatcttggaactaatggtgcaggaaagtctacgacaattaatatcttaactggtcttttaaagccaacttctggaacaattaaatacgcgccaaatctaaaaattggggtagtttttcaagatagcgtcctagatgacaatctaactgttaaagacaatctgtatctaagagctaaaatgtacaaaactttctctaaggattggctaaagcaattaattgagctaattggaattaagaaatttttgaatcaaaaatatggtactttgtctggtggtcaaagaagaagagttgatattgcccgagccttaatcggtcatcctgatttgctgtttttggatgagccaaccactggacttgatttacagacaagattggtaatttggaatttactccaaaaattgcagaaagaacaggggttaactattttcttaacaacgcactatcttgaagaggcggaaaatgccgatcaaatgtacatcttagagaacggtaatattttagccaaaggatctgcaagtcaaattaaggccaaatatgcaccaactaaattgatagtaacgatgaaagccgctaaacagccgcttcattctcaaattcttaaagacaataaatttgagctagatgatctagattcaaatcaagcaattgattttctaacaaaaagtaaagttaaaattgcagattttgaatatcaccaaggctcaattaatgatgcatttatcaagattacaggaaaggaacttcaataatgtttgctttagttcaacgaaatatcaagatttatttttctaacatccctggcgtaattatgtcatgctttggagcattaatttcattctttatctatgtaggatttttacagaaaaatttagaaagctcctggcctcaaattgcaaatgtcaagcaaatgcttgatttatggatgatggcaggaattgtagcaattgcagggattacaacttcttttcaagcactaggtcaattagtcaaagatcgagaaacgcgcactgctgatgatatgtgtttgactgatctttctctttcagagcaaaatttggcctatgttttgtctagttcaatcatcagtttcttaatgcaaatcattacatttgtggtgatggatgtttactttacagctgttgataaaattaatatctcacttgaaaatagcttattagcgttaatttttatggcattaggagcagttggagcaacactgctcaatgaaataattgtgctctttattcattcttcaactacgtttagtcgtttatcggcagtcatcggggcaatcgctggatttgctgtcgctacgtatcttccttatggaactttgtcttctacggcgcaaactttggtaaaattagtcccaagtagttatgaagcttctgctttgagaagtttatttttaaatgaaattagcgaaaatcaaatgccagcgagtgtaagaagtacgatggttaactatttaggaattcatttcaaaattaatggctatcagctaacgcgtgcagatacaggctatgtgatgattggaatgattttaattttaagcctagtgattattcttgcttcactggcaataggaaagagaaaagttcaagttgaaggttaagtttcaaaaagatccatctttggaggatgagatagaggttgaagttagagcaagtgcagaaagtggcacagttaagcgactggtcagttacctaaataaatttggtaaaagagatcgaaatcttttacctgtgaaaacgagtgaccggatagttactgttaaaagggatgagttgattaaagttgaagttcagggcaccagcctaacttattacaccttgagcgaagtagtaaaaacaactggacgattgtaccaagttttggaaaacctgaatgaagattttgtgcaagtttcacgtcattctgtcattaatttgaattatttagaatcattagagagtggttttgcaggaaacatggttgcgattttagctgaaggattgaagactgatgtttctcgtcgctatttgccagatttagaaagagagctgggactgtaaaatgaaatggtttggaaaatgcatagattattttttcacaggaatgggatttggcgcaatttgctacgtatgtattatgacttttctttatcctggagtgggtttgactgttaaagaaacagtttcggttcttgggatttctggaataattggttttctatcgatgatttttaaaactgatttaccaatgagtgcagcttttgcgattcattttataggtacttttattttattcatgttgatggctactattaatcactgggtaattaatataagtagtatcgtaatgttcattcttatgtatgttgtgatttggctcatttgccttttggaacaaaaaaagacagtgaaccgaatcaatgataggattaagaaaagaaatctaaaatagaaaacataactgcgaggaaaacagatgactttaaagattcgtactgtaaaaatgaatgatttagatgcaattgttgagcttgaatcaagtgcttttcatatgtcagaagaaatgacgcgtaaggatatgatcgggcggattgaaaattactcagatacttttttagttgcggaagttgatgaaaaagtagtgggacacgtttttgggcccgcaagtaaagatcgctatattaaggatgagctctattttaaaaatcaaccgaataatgcacagtatccttatcaaacgattttgagtttggcaactagaaaagaatatcgtaagcaaggaatcgcatcagctttaattgaagaattatgtaagattgctcaagcgcaggatagaagtacagttacactgacttgtttacctaagctcttccatttttatgaaaagcgtggttttatcaatgaaggtaagactagtgatgatattccagatccagatgatgtaagtagttataacatggtgagagcgttaaaaatttaaatttttggaaatcaataagagtagatctataatttgaaataaaaaaggggggtaactatgagtaatgaattttgccataatggtatgaaatgtcaacagggatgtctatgcgctagtaaagatggtgtttgtcattgttccatggtaagtgagaaaaagtgcgcttgtcagagtcattgtaaagaaaaagaagagtaaaatcaaaaatctcatgttactaactcaatagctaacatgagatttttttaattctcggaatctgttttctaaaaattgataattactttcccaagactttttctttgcgcaacatctgccaaggcggcattgacttcagtaagggaatattgatttccaatgaggggatgaatttggttcttctctaaaatcttagcagcttccttgagctgttgaccattagcttgaacgaagatgaagtggtagttttggttgcgttttttggcttctttttcaattttgcgagcagctacattaaaaagcagttccttagctaatcccatgttcattttcttagcaaattctctatttggcatccctttcagcgaaacaatctcgccgccatctttaagaatagaaagttgcttaacagtttcttctccacctattgtgtcgatgattgcatccacattagcgacagctttggtataatcttcggttttataattgagaaatttttcaacgcctaatttttctaaaccagcacgactagtttcgtttcctgtagtaataactttgtagccttgcgcaattgctaaaggaattgccattgcgccaaaacttccggatcctccggagatgaaaagagtttggccagcttttagattcaaaagttgaaaagcctgcatcgccgttaatgcagttaaaggaacagcggcagcttcttgatcacttaagtattcaggaactttagccacagctttttcattaatcacaattttttgagcaaaagcgccaatgttatctactggattacgggcaaaaatacggtcgccaatcttgaagttagtaactttaggatcaattttttctataattccaacaaattcatttcccatagtttgaggtaacttgtacggaacaaccaatttaagatcaccatgagagataaggttgtctaaaggattaacggctgcagttttggttctgataagtaagtcatgtgcaccaagtggctgagaattaatatctcgaatttcaattaacggatcttttttatcgtatttaattagttgagctgccttcatgatttctacttctttctaattgtttcagtctatcaattacatctgctaaagtgtcgtgttgcaaagaatgctggagccttttttcggcatcatctaaaaatggaaagacggcgttaacaatgttgcgaccgacaggacattctgcatttgcattttggtgaacttgaaagatatgagggttctcttcttcaacaattttataaatagtgaggagatctaaatcaccaggatcgactagtaattgaattccggtttttccacggtggctctcgataattttatgatctttgagtagactcattattttccgaatataacttggattcgtgccaacgcttttcgcaatgtcaactgaattaattggatgtggactaagcgcaatcatagatagaatgtgaattgcaatagaaaatttggtatctttcatctaaaatactcctaagtacataatgtatctttcactgatacattattatataaaatgaaagacgtcaaataaaacagaaatagatttctagataagcaaattgttgtgattgatttacgatgattaaataatatattaagactaatgtatgaattctcttggctagaaataaaacaagacgtattattgcgaacgagacttttattttagtatttggcaaatttgaaaaagatttatgttggatatgcaactgataatttaagctgttttctatataagaggctaacaataaaaaataggaggagaatatgagaaaaaagaggatggaaaaggttagtcaattaactttgaagacaccaataggattactgcagataattgctactgatgaagcaatagtcagcataaaacctactggtcatgaagaaaatatagtgggaaatgaagcagcaaataagttagctcaagagtgtaaagtagaactaacagagtattttactggaaaaagaaaaaaatttgatcttcctttgaagcaagaaggaacacaatttcaaaagaaagtgtggcaagaacttaaacaaattccttatggggagacaaaaacttacggtgagattgctaaattaatagataagccaagggctgcgagagctattggaagggccactcacaataattcgattatgattttgattccctgtcaccgagttgtcggcgcaaatggaggtctaactggctatgcctatggtacgaaagcaaaaaagtttttacttgagcttgaaaggaaaaataaatgattgtactaataactggtgcatcccatactggaaaaactactctggcacagcatttacttgaaaaatataaatacccatatttatcttattgatcatttagagatggggatgagccgtactgattacaaaaagcttacatctgaagatgatgatcaacttacgaactgtttgtggccgattgtatgagaaatgattaaaactgcgattgagagtaaacagaatttaattgttgagggatgatatattccttttgactggcaaaattattttgatgaaaaatatttagagcagattaaatattattgtcttgtaataagtaaaaaatatatcgagaataattttgcaaatattaaaaaatatgcaaataaaatcgaaaatcggttagacgatagttgctcaatagaggatatcttagaagataatactcattatttacaaatggctaaaaagtatggtttaaactatgtgctaattaatgagcagtataagattgagattgatttggatgattagaaaagtaaaaactcagctggttaataagtaattaaggactaaaaagctttatatgtttttattgtctgctatatagagaaaatataagatattaatttttgtaccatataaaacaaaaaagctcccgttcaatttgaacgagaagctttttacttagttaatttatgtactttatgagccaaaaccatttctttgtttcgatcttcataaattgcgtcttttacgtagttccagggtgccattaggcgacctttattgtttttacggaaaaggaaatcagcatgatgattttcaaggtgacgtagatatctcttagcattttgaacctgagtgtgatgctttagatttaagcgaggttcaaaatcaataatcttatgatcggcattaaaaattggtcttactttatgatgccagtgacgagcactagcaacatgacgactaacttttttgccagcctccacaatattttctttagtggctaaactattccgatcttttaactctgcatgtggatccagatagtagttccctagaccatcttgacggtaaagacgtaattttttgaatgatttattttttttgtcagtcttcacttcaataacgtcaccattagtatggttcattaaatacatgtgatgttttttagtgtaatttacacttttcatgatcagaaattcacctctttatatatcttatgaatctatattatagacgcattttaaagtaaagtatagtgattaaagtaggactttagttatttataaaattaattaaagtttagagaaatagtagtaagaaaagacagctgagataggcttagaactgtcttttgtaagtatcgtaaggtcaactagcggataaaaattttttaagtcatgcagtaagtattatagctacagatgttttaaataaaagttatgtatataattaagagataagatgagttcttatctctttttttgtgaaggaattaagctatgatagataataaaaatttgttgaagctcttaagaactgaacttcaaaagatgaataacggtgataaaattagatttttaacttataagaaggatcgaagcattcttgtggaaaaggatggagatacttttacaataattgaaaatggatatcgccaaatggtgtgggaaaatttaactaaagcagaagtgttaaagagaatgaaaaagttacaaaagatagaattcccaagaagtaacaaattatatttaagtaagtaaaaatgacggactgtaaaagctacaatctgtcatttttacttacattctatttaattttgatatctccatcttgtgtagaagctgttaagacattagcgctatttttattctgtgtaaaagtatcgctagatgaatcacctttaactttgatgtctccatcatctacattaaggttatagccactaaaattagacgtagaaatgtgaatatctccatcatctgtgtttatcttaaatccatttttactatttaatttgttgatagtgatatctccatcgctggtatcaatttttccacttggagattttaaattgttaatatcaatatcgccatcatcagtattcaaagaaataggatttgtggtagcaatgttttccacttcaatatcaccgtcatctgttgaaagatttaaactcttcaataggtgttttggtacggtaatagtgatagtaggatctccgttaatgcggtgaataccagaggctgattgcttaattgttagactaccattctttctgctaacagtgggctttaaattcttaggcccttcatattcaacgttatacttatcgccatatttaacagaaatatctgttatggcagcagagacttttagttgattaaatccctgattactaatagtagttttaatttcgggtttattattagagttagagataataatactacaagctgaaagagtcagtacaagagataagagcataaaaattaatgcaaactttttactaatatttttcataaaaaactcctaagataataattaggactaattatcttatatttattgagtaaagtaaatttaaataaaaattggagggaaagataatgaaaaagatgccaccaattcaaaaaattttagaagcttacacagcaattgtggataaacatgtggaattaaaaaataatgaagctttggttacctcatcaaatggtgcaaagacctatacggtaagctgggataatgacatttaccattccaatgacaatgcgacttattggcaaggttatgcggggtatccgataattgcggttttgatgttgcaaggaaaaataccctttgatcaaaaattggctgataattttgcatcagttaattggaatgaagtgaatgcaaaatttaaacgtaattatgctaaagcggcctctgaagttatcaagaaaaaaggattagatgaaaaagaggttatggttgaacttgagagggtttatggagctttaaaggatctaccaatcacaattaaacgtggctcccttcgtccacctaaggctagtaagtaattaagaattatgagttgctcttcatccatcgccttaataactggaaaaagtgtctttcctaaatcagtcaatgaatattcatttttagattactgtataaacttcttcattaataatttttacttccagtctaagcaaagctcttgtttatgcagttcttcaggtaattcgtcacgatcagttttatgattatctagcttagcgccagtgatttgtttagtaaatgaatcaatacgacgatttgaatcacgtaaatcatagtaagtagtaactactttgtcatagtcacgtaattcttttacattgaagtccttatcatattttccttcaaaacaagtgaattttaatggtaaacgtggttttaattgtggcttttgatcaggcacgccaacttgcatccctaatactgggaaagtcaatttaggtaaatcaagcgtcttaagcatttcaagtggatgatcattaactgttccaaggggtacgtagcctaaatccatactttctacggcattagcaacattttggtaggcaagtaaggtatcttccattgcttggaaaaagatatcagtagtatgcacacgaccatcatccttgccaagttgttttctaatttgttgattacgatataaatcaactacaaagatgaataaatcaccttctgcaccaacatatttttgattacataattctctaatttttttcttctcctcaggatcaataatatgtatcaagctagcattttgcatgaacatactagttggggtttgtgcaaaaactgagtataaagtttctaattgttctttatttaaagttgtatctttaaattctcgaattgaacggtgatttaattgtgcatcaatagttttgttatgtatcatttttatccttcttgctaataattagtaagtatattatagcagatagttattattatttttctctttgtcattaattttggataaaaaaagatgcacagaagtatatacttctatgcatctttttatgtatttatttttgcttaatcaagtaagtcatattttaaggtcattaagccgtgaccttcgttaaccatatttcctagcaattcaacagtattgttgtaaactgtatcagccatcttttgatttgctttgtttagcttatcttggagttcatcgccagaatagttttcaatttctttatcagtttcatgttgaattttatggcattgagcaagactcttttgttcaaaatcggcttctaattcaccataaacacggaagttagtatcacctaattgagcagttaatttattcaaccagaagatcttatttaaatcaaatttaggaccagtctggaagctggctggagtagtagtgatattggtgtagaaaggaaccatgctgttaaaagtatttggtccaaatgctaaccattgaacaccagcaatttcttctggaacgtcatttctaatttgtaaaatatgagtttcaaagtttctattaataccaattggacggaaagtcttcttttgttcaggtgtaccttgatctccatatgcatcaaaaggagtatcttgatagtgagaactttcagcccatttaatgtcttcaatactgatcttgcgatttgcgtggcaaatgaatggttgatcttgatcacttggttcaccaccaaaattaggatcaaaatagttatggatataccaagcacgtggattgttgtagtgagcatctttaatcgttgaagagccaaagatgtgtcgcaagttatagccctcaagatctggatttaagtgatattcttcaattaaatcttttaaatcttttgatgaagcaaaatcatcattatcgaaataaaattcatcgatatttagacggttaggagcgattacgtacgcatcatctggaatacggcgagctgcccagtggtggccaccaatagtttcaaggtaccaaatttcgtctttatcagaaaaagccataccgttcatttcgtaagtaccatacttttcaagtaaatatcctacgcgttctacaccttcataggcagaatggatatatggcaaagttaaagtcacgaaatcttcttcacctaagccgcctttttcaaggagtggatcaataccttgaattcttgaattagtggtaatagtttcagttgcagtcatagcaatattatctgaattaataccagcagcagcccaaattccattttcacctgatgcatcaggtgcactagtatagcgaagaggattaggtagaagatcttcatcatcgatcttttgatgactaattacgctttcgtagtgtttaggttgatcagctggcattactacatcaaatcgctcaggaataatagtacggccgccatcttcactacgggctatcattgttgaaccatcaatagttgcatcttttccgactaagatagtagtacattcggttggtttcataaataaaatcctttctgaattctttacttactattgtacgcgaaaatgtaaggtcttaggaaataatctggcactagttaatgcttttctcgatagtatttgggactaaggccagtatagcgtttaaaagcttttgaaaaagtaaaggcatccgtatacccggtaatatttgcaatttgctgaatagcgtaattactgtttaatagtttttctttcgctttttccatccgtaattgggtaagaaatgcttgtggagaaaggttcagatttttcttaaaaatgctgtataagtagcttcgagataggtcgagatcattacatagagcactaattgtacaagtagaattagcagaattttgttctaaataattaaccgctagacgaaattcttcattagagtttttagctttagaatttaattcagcaggatattcggtgattaagtggtaaaagaatgtatagattaatgactcaattaatacatcgctagcaagggaactacggtagtgaagtgaatcgaaaagttgttttaggctttcgtaagtttcacttgtttgaagctgacgtaaataatattttttagtcaacttagaattgtctagtaatcccttgatttttacacctgaaaaaccaatccagaagtatgaccagggttcagtgccgtcagcttgataaaaacaaggtatatcctttggaagaaggaaaatatcgccagcatttaagttcacagcatggtgattagctaccgaaaaggttcctttacctgattgaatatagtgaatgacatagttgttacggacattattacccttgaaaaagtagtttggaggacaattttcttgtccaaaaaataaaactttagtctcaatactgtgattgtttaatgtatgatattcaccattcattgctcttgtcctcttatcaaattcccatgttaatgatggatatatgttttcaaaaatatatttagtacttataatgataccatttttacggtaaaacatatcattatgattaaaaacaaattgacataatctaacttaatctagctattttataaagcgtatacattctacataataaatattgttgaaagcgaatacaaaaaataaaagagggaagattatgaaagataaagatcagggaaaaatgtcactgggtgctagactagcatacagttttggtgcatttggtaatgattcattttatggattactatcaggatatttaattatgtttattacctcgcatttatttaatacaggtaatgcggctgaagatgccagaatgatcagtatggttacattgattatcatggtgttaagaattgtcgaattatttattgatccatttattggaaatgcaattgacagaactaagacccggtggggccattttagaccatgggttgtagttggtggtagcatttcagctgtgattttattgatattgttcactaacttaagcggactttaccaaaagaatgcaatcttatacatgattgtttttgcagttctatatatcacaatggatatcttttattcatttaaagatgttggcttttggtcaatgcttccatctttaacaactaattctagagaacgagaaaaaactgctacttatgctcgtgtaggatctactattggtggtgggttagttggaattctagttatgccagctgttatctacttctcagcccgtccaacttctacgggggatgatcgtggttggttcatttttgcagcaattatttgctcaattgcatttgtttctgcatggtgtgttggtttatttactagagaagttaacagcgatattcgtaaaaataagaaagatactaagggaattattggtatttttaaagctttatcaggtaatgatcaattaatgtgggttgcacttgcatacttattctatggggttgcaattaatattactggatctcttgaagtttactattttacatatattatgggaatgccaaaagcattttctattttttcaacgattaatgtattcttaggaattattgcgacatcattatttccacttttatctaaaaaaatgagtcgtaaggcactctttacttcttgtttagctgtaatgctttgtggaatgggattatttgcagtagctggaagtaatttaccactggttttgcttgctgcctcaatttttggctttccacaaccaatggtattcttaatcgttttaatggttattactgactcagttgaatatggtcagttaaaacttggacatcgtgacgaatcacttgcgttgtctgttcgtccattaattgataagtttggtggtgccgtttcaaatggtgttgttggtcaaattgcgattatggctggaatgactactggtgctactgcttcttcaattacagcagctggtaagcttaattttaaaataatgatgttcgctgtacctgctgttatgcttgtaattgcaattttaatttttgcaagtaaagttattttaagtgaaaagaaacatgcagaaatcgtagctgagcttgaaaagacctggggcaagaaatttgataaggatagtgataatgatgttgatagtgatgtcctcattgccactccaatttctggtgaattgataaatttaaatcaggttaatgacaaaacattctcatctggatcagttgggcaaggctttgcaattaagccaagtgatggaaaggtcctggctccatttgatgcgacagttagacaggtctttactacaagacatgcagttgggctagttggtgataacggggtagttctattaattcatattggacttggaacggtagaactaaacggaactggatttgtatcatatgttgaacaaggtcaaagggtaaagaagggccaagaattaattgaattctgggaccccactattaaaaaggctggtctagatgacacggttattgtaatagtaacaaattctgataagttttcagatattgacttaatggcgaaaactggtcaagccgtacaagcagaagataatattttagaattaaaagtaaagaaggaagagccagtattaggaggcggagaagttgaaccaactaattaattttgataaaaaaaataaagtttttcatttacataataatcaaatttcatacttattagcagttgaagatggaaatacacttgctcacgtgtattttggtaaaacaattaaacaatatcatgggcaattacgctatccgcgagtagaccgaggcctttctggtaatttgccgggctcactagatagaactttttcacgtgattctttaccaaaagaatacagtacagctggtgaaatggattaccatactccagcagcagtagttcgccaaaaggatggatctaacgccttatttttaacttaccatggttataaaattgtggccggaaagcccgatttagtaggattacctcattcttttgttgaaaatagtgatgaggcagaaactttaatagtcaatttaaccgatgaaaagagcaaaattaaatttgaattagcttatacaatttatcgtgattatccagtaattacccgttcagtaaaagttgttaataatggtgaagatacagttaatattgaaaaagttgcttcaatgcaaattgattttgttgatcgtgactttgaatcaattactttacctggtgcgcatgcacatgaaagacgagtagaacgtagcaaaatcaatcaaggtattcatgtttattcaagccatcgcggcacttctagtcatcaaatgaatccatttatggcattagttgatcctgatacaaccgaatttgctggggatgcttacggatttgtattcgtttactctggtaatcacaagtttgaagtggaaaaagaccaatttgctcaaactcacgtcaatattggcattaataattttaactttaattgggagttgaagccaaaagatagcttccaaacgccagaagtcttaatgacttattctaatcaaggtctaaataagatgagccaagcatttcatagcttgattcatgatcggattattcgtagtaagtacaaagatcaagttcggccaattttagtaaataattgggaagcaacttacttcgactttgatgaagaaaaattaaaaccaattgtagatgatgccaaagaaatgggtattgaaatgtttgtccttgatgatggttggtttggtcatcgtgatgatgataattcttcactaggagattggagtgtttttgaaaagaaattcccgcatggattagatcattttgctaattatgtccatgaccaagggttaaaatttggcctttggtttgagccagaaatgatctcaatggattcaaacttatatagagagcatcctgactatttaatgcatgttccaggaagaactccaagtccatctcgtaatcaatatgttctggatttaggtagaaaagaagttcgtgacaacatatttgagcaaatgaataagattcttgaatcaggtaagattgattacattaaatgggatatgaatcgtcacttgtcagatatttatgaagcagatttgccagctgcaagacagggagaaacttaccatcgttatgtcttaggactttatgatctgcttgaaaggctagttgatacttatccaaacctattaattgaaggctgttctggtggtggtgggcgcttcgatgctggtatggcatattacaatccacagatttgggctagcgatgatagtgatgcaattgatagattaagtattcaatatggcactagtttagcttatccacaatcaatgatgacttctcatgtttcagttagtccaaatgagcaaaatggacgaattacaccattcaatacacgtggaattgtggcaatgtggggtgatttaggttatgaactcgatttaactaagatgagcaaagaaaatcgtcaagcagttaaagatcaggtagaaaaatataaaaagattagagaagttacccaatatgggactttttaccgcttaaagtctgctcaaactagtaatcaatgtgcttgggaaacggtctcaaaagataaaaatgaagctgttttgtcagtagttaaggtaatggcaagtgctcaaccgtatttaactaagactaaaatggttggacttaatccagaaaagcactatgaagatcaaaagacccatgaaatatatggtggagatgaactgatgaacttaggaatttatgattcagttgaacacggtgatttcaaggcttatattcatcactttaaggcaatagattaggattagtagtaatgacaatttcaaataaagtaatgctcataacctatccagatagtttaggtaaaaatattaaagatttagatgacgtactgcacacagacttaaaaggtgctgttggaggagttcatttgttaccattctttccctcaactggtgaccgcggatttgctccaacagattattcaatggttgatcctcaatttggagattggtctgatgtcgaaaagttaggcgaagactactaccttatgtttgattttatgatcaatcatatttctcgtcagtctaagtactataaggattttcaaaagaataaagatcaaagtccttatgctgaccttttcctcagttgggataagttctggcctaagaatcgaccaacgcaaaaagatattgaccttatttacaagagaaaagatcgtgctccatatcaggaaattacttttgcggatggaagtaaagaaaaactctggaatacttttggtgaggagcaaatagatcttgatgttcgaaaagatgtaactaaacagtttattaagcagactttaaataatttgattgatcatggcagtgacatcattcgactagatgcgtttgcttatgctattaagaagttagatactaatgactttttcgtagaaccagaaatttgggatctattgaaagaagtacaagatgatatttcagctaaaggcgcgctaattttgcctgaaattcatgaacactattcaatgccatttaagattgcaagacatggttactttatttatgattttgccttaccaatggtggtgctttattcactatatagcggtaaaagtcagcgtcttgcttcatggctaaaaaagagtccaatgaagcagtttacgacattagatactcatgatggaattggtgtagtagatgctcgtgatatcttaactccgaatgagataggatacacaagcaatgaattgtataaggtcggcgctaatgttaaaaagaaatactcaagtgcggaatatcataacctcgatatttatcaaataaactctactttctactctgcacttggtgatgatgataaaaaatactttatggctcgacttttacaagtatttgcacctggaattccccaagtctattatgttggaatgcttgctggtaaaaatgatattgaacttcttgaaaagacaaaagaaggtcgaaatattaatcgtcattattatagtcgtgaagaaattcatgaagaagttcaacgtcctgttgttagttctttaattaacttattaagatttagaaataatgaagcggcatttgatttgaatggaagtattgaagttactactcctactgaaaatgaaattcatattatccgtttgaatcaggacaaaacacgaaaagcagaattacgtgcaaacttagaaaccttagcttataaagtgttagtgaatgggcgagagatggctttttaatacaaactataaatatttttgaagaagaattaggtagaaattgcctaattctttttttgaagcagatctagaaactaagtttatagacaatataaggtataatttgattaatgaaaaaattctgcaagcatgggaggaatcatatagatgaattatggagaaaaatcacctgcactttgggatgcaattaaaagtgaagagaaaagacaagaagatacaattgaattaattgcatcagaaaatattgtttccgatgctgtccgagaagcacaaggatctgttctcaccaataaatacgcagaaggatatcccgggaaaagatactatggtggatgtcaatatattgacaaggtagaacaattggcaattgactatgccaaaaaattatttaatgcagaatatgcaaatgtgcagcctcattctggttcacaggcaaacatgacagtttataatgctttgctaaagccaggagatactattttagggatgggtatggatgctggcggtcatcttacgcatggttcaaaggttaatttttcaggaaaaatttttaattctattagttatgacttaaatcctgaaactgaagaattggattttgatcgaattagacagcttgctatagagaagaagccaaaattaattattgctggtgcttctgcttatagcagaattattgattggcagaagtttcgtgagattgcggacgaagttggcgcctacctaatggttgatatggcgcatattgcaggtttagttgcaacgggagcacatccgagcccagttcctatagctgacgttgttacaacaactacacataaaactttgcgtggtccgcgtggaggaatgattctatctaacaataaagaattagggaagaaaattgattcggctctctttccaggaacgcaaggtggaccactagagcatgttattgctgcaaaggcacaagctttttatgaagatttacagccagaatttactcaatacattgatcaagtaattaagaattcaaaagccatggctgaagaatttaaaaatagcaaaaatattcgcgtggtttcaggtggaacagataaccacttgatgattattgatattaccaagactggtgtaacaggaaaagatgcccaaaatttgctagactctgtaaatattacgactaacaaagagtctattcctggtgataagcgaagcccatttattactagtggattaagaattggaacaccagcaataactagccgaggctttaaggaacctgatgctaaagaagtggctaaaataattattgaagttttggataagcctgaagatgcaggagtattggctgaggcaaaagaaagagttaatgatttagttcagaaatatcctattaaataaaagctattgacagaaaaatataagccaattacaatataattaaattttttaaggagtagttaattatgaatacacaagctaagtttatgaaaaataatcgttggcaaggccagtaaatcaggttgttaagcaagatgcaacctgaaagactcagattgtatctgtgctggctgtgtatttattgtggtctgcatggaataacatgcagacctttttctttttgtgataaaaaagtaacaggaatctgcatgtgaaggtagattcctgtttttttggagaaaaattatgaaaagaatgtatggattaattgtaattttagtagcttttttaaccatagctttttttggagaaaataaacaaaaagaagaaaataataaagttccccgagttggtgtattaacccttatgcgtcacccagctcttgatgagatatatcgcggctttcgagatgagctgaaagaagagggctacgtaaatgggaaaaatatcaaaattgactatcaaaatgcaaataatgatcagagtaatttacgtacgatggcaacaaaactaactgatgaacaatcaagagcgttagttggaattaccactccagctgcccaagcattagcaaatacaacgaataagattccaatagttttaggtgctgtaacaagtccaaaaactagtgggctagtaaaaaatgaaaaacatcccgaaaaaaatattactggggtatcagatgctgctccaattagacaacaactagatttaattagagagtttttacccaatttaaaaactttaggggtaatttatacttcgagtgattcgtctgcggttagtggctttcatgagattgaacgggaatgtaaaaagagaaaaatacctttaaaatctttctcaattgcaaatagtaacgatcttaatcaagtttcagagcagatgtttagtcaagtagatgccgtcattgtaccaactgataacacaattgctggagcgatggaaacactagttaaaaatggtaatgctgctaaaaagccaatttttcctgccgcagctactatggtaaaacaaggcggtcttgcaacttatagtgttaatcaatatgagttaggaaaaatgactggaaagatgactattgaaattttaaagggtaaaaaagttagttctttaccaatcgaaagagtgaaaaagggagaaccagttgttaatttaaaagaagccagagaattaaatcttcaagtaccgcaaagatttttagaagaatgtcagaaaaaaggagttgtatatagatgaacttgatcgtatctgctattggccagggattgctatgggctttgcttggcttaggattatatttgacatttagaattttgaattttgctgatatgaccgtagaaggaacctttccattaggtgcagctgttgtagtagctaatatttcacacggaatgtccccatacttagctactttcttagcccttttagctggaatggcagcaggtttagtaacgggattattgtatacaaaaggaaaaattccaattctacttgctggtattttaacaatgacggcaatttattctattaatttaagaattatgggcggttctaatatttcgttgattggtaagaagacattactcaacaatgaatttttagaaaatttaccccaatattttaatagtgttgctttgggtattgttattgtagtagtgattactggaattttaattttctttttaaatacagattttggtcaagcttttattgctaccggagataattcaagcatggctaaatcattaggaattcatacagattttatggtgatcgtcggattaatgctatcaaatggaatagttgccttatgtggagcattaattgcgcaaaataatggttatgccgatattaatatgggaattggaactattgttattgctttagcttcaattatcattggtgaagtagcttttggagaattgaccttaaatcagcgtttagtggcggtaactttaggtagtattatctatcgtttgattttactcgctgtactgcaacttggattttcagctaatgatttaaatttaatctcttcaattgtcttagctctatgtatgatgcttccacaattagaaaaagtcttacatttgaaaaagccagtagaaagaggtgtgaaaaagcatgactaagccaattctagaattaaaagatgtcaaaacaactgttaaaacagctgatggtgaaattgttccaattttaaaaggaattaatttagaaattagacctggagattttattactataattgggacaaatggagcgggcaaatctacactttttaatacgattgcgggtagtttaaaacctgatagtggtattcttcggcataatgggcaagatattacgaaaatgagtgaagaaaagcggacacaatttattggacgagtttttcaagatcctaagatggggactgctccgcgaatgactgtggcagaaaatttattactagcaacaaaacggggaaagagaagatttttaaagattagaagacttaagcaaaacttacctcgttttaaaaagctagctgcagttatgaataatggcttagagagtcgtttaaatacgtttgtagaaggcttatctggaggccaaagacaagctttgagcttcttgatggctacaatagaaaagcccgatattttattattagatgagcatacagcagctttagatcctcatactagtgaaaatctactagcagtaactgataagcaaattaaagaaaataaattaaccgccttaatgattacgcatcatatggaggatgctttaaaatatggaaatcgtcttttggtgttaaaggatggtcaagttaaagcggatattagtgaagaagaaaaaaagaatttaaaagtaagtgatctttatagttattttgaagattgatctaaaacctagggctggttgtcggttctaggttttttagttaaaataatttttaattgttttaagtatagatttaatttttataaagaagggatggaagagatgtgaataagggacacaaaataagtttattttcagcaataatgctagcccttaattcgttgattggatccggatggctttttggctcaggctcggcagcaaaaattgccggcccagcggctatcttatcttggatcattggtgcagttattattattgcgattgccttaacctatgttgaactaggaactatgtttcctgaaagtgggggaatgagcaaatatgctcaatatagccacggtcccatgcttggttttatcgctgcctgggcgaattggatttctttggtaaccttggtgccaatggaggcagttgccgctgttcaatacatgagttcttggccatggaagtgggcaaactggacacatcactttatgcaagatgggaatataactacaccggggctattattggtatttgtgttcatgattatttttactttaattaacttctggtcaattaaaatcatgacccactttactaacttgatttctgtttttaaagtactcttgcctacgataacaattattatgctgtttgcatctagttttcatcctgctaactttggtcacgatgtaaaaacatttatgccttatggaagtagagcaatctttgaagcagcttctggtgctggtatcattatgtcttatgacgcatttcagacaataattaatattggtggtgagttaaagaatcctcgaaagaacattattcgtggagttttaatttccatgtttgcgacagctgcaatttatattctgcttcaagtagcctttattggagcagttgatccaggaatgcttgctaaaaactcctggcatggaattgattttgcgtccccatttgcagatattgcaatccttttaggaattaactggcttgtgattttactttatatggatgcttttgtttcgccatttggaactggagtagcttttgtcgcaacagcatcaagagcacttgctgcaatgacatatacaaaacacttaccagcgtggttagggagacttaatagacgctatctggtgcctcgttttgcaatgattgcagatttaattttagcgatgattttagtaagtgtctttaggaactggaatttacttgcaacggtaattacttgtgcgactttgattgcttatttgactggtccagttactactattactttgagaaaaatagcaccagatttggaaagaccatataaacctaattatatgcgctggtttgctcctttaacttttgtattaactagtttggctatttattggacgatgtggccaacaacaattcaagttattctggttattcttgtgggaattccaatttatttctattatgaagttaaatatcaaaagaaagattttaaatcgcagtttaagcatgctgcttggcttttagggtatttagtatttatttctattatgtcttattgtggtagcgacggctttggtggacaaaactggattaaatatccgtgggattttctgttgattgcaattgtctccttgatcttctataaagttgcaattgatacaggactagaaaaagttgatccggcggcgataaaagtaaacgaaaaaattaagcttaagaaggactagaattaagtacactagtataaattagcttgaattatagttggaaaggtgctatccttaactagtcgtaaaataatctatgatctgaaatattggtcatggcaaaggagtattaaacaatgagaaaagggattcatccagattaccaagaagttgttttcatggactcagcaactggtgctaagttcgtagctggttctactttaaaaccagaagaaacaattgaattcgaaggtaagacttacccattagttcgtgttgaaatttcttcagattctcacccattctacactggcaagcaaaagtttgcacaagcagatggtcgtatcgaaaaattcaacaagaagtacggtatgtcttcaaagaactaataattcttggtttttaccaaaagagcagcccactttggactgctctttttttatgcttaacgtggtataattcttattgatatgcgtgagacctttttctgactgcgataagtcagtataataggagtacatgcaattttaggtaggagtaatttatttattatgaaaatgcaacttgctgagatcgctaaagcattaaatagttcagttaatatgggagaagacaaggtcattacatctgttgtttttgactcaagaaaagcaactcccaattctttgtttattcccttagatggtgcaagggatggacatgattttgtatctaatgcaatggcaaacggagcagaagcaaccctttggaaaaaaggacatgagggtatgcctactgatgtgccagttattgaagtggaagatccgctaactgcgcttcaaaatttagctaaatattacttaggtaaagttaatccaactgttgttggtattactgggtctaacggtaagactacaactaaggatatggttgcagctgttttatcaaaaagatttaacgtgcataagacacaggctaactttaataacgaaattggggtacctgtaactattttagagatgaaaccatctactgaaattttagttcttgaaatggggatggatcgtccgggacaattacaccatttaagtgaattagtaagaccagatgtttgtgtcattacaatgattggtgaagctcatattgagttcttcggtactagagataagattgcagacgctaaaatggaaattactgacttcctaaaggaagatggtaagtttatttacaatggcgatgaacctttactagaagagcgtgcagctaagattaagcaagaaaagagtacttttggttttagagaagaagatactgtttttgcgactacatttagatcttacatgcaccatgctacttttgaagtaaatgggtcaacacagcaatttaaaattccaatgattggaaaacataacgtctcgaatgctcttgcagccattagtgtaggccgccattttggtgaaaatgatgaacaaattgcccaagctttagctaacttcaccccaacagcaaatagaatgcaatggaagaagggtgatgtaggcgaagcaattatggatgatgtttacaactcaaatccaattgcggttaaggctgttacgacttcgtttggacaagtaatggtcgaagatggtgggcgcagaattgctgtcttaggtgatatgttagagcttggagatgaatcagctgatcttcatgcgtctcttgcagctagcttggatccagcaattattaatgaactatatttatatggtccagagatgaaaaacttatatgatgctcttgttgataagtacccagcagaaaacttgcactattatccacaagatcaaatgaatcatatgattgatgacttaaagaatgatattaagccagctgatattgtaatgctaaagggatcacatgggatgcatttggaaaaggttttagaccgtctcatgtaggaaggaattagatatttgaaattttctgaaatgaacttaaaacctgagattttaaaagctattaagcgttcaggttttgaagaagctacaccaattcaagaaaaaaccattcccctagttttggagggaaaagatgtaattggtcaagcccagacagggactggtaaaactgctgcttttggtttgccaattttacaaaacttagataagcaacacgattcaattcaagctattattattgaacctacccgtgaattggctattcaaacccaagaagagttgttccgtttaggtcgtgatgaaaaagctcgcgttcaagtagtttatggcggtgctgatattagacgtcagattcgtgctttaaaacaaacgccagcaattttggtaggaacacctgggcgtttgcttgatcatttaaaacgtggcacaattgatatttctaaagtcaaaacaattgttttagatgaagcagatgaaatgcttgatatgggatttattcaagatattgaaagtattttgaaatatgcatcaagtaaacatcaaacattacttttctctgctacaatgccaaagccaattttacgaattggtgaaaaattcatgaatgatcctgagattgtaaaaatcaaaggaaaagaattaactgctaatttaattgatcagtattttgtgagagcaaaagaaaatgaaaagttcgacattctatgtcgcttaattgacgttcaaaatcctgatttagctgttatttttggtagaactaagagacgtgttgatgaattaacacgtgggctacaagcacgtggatataacgctgctggaattcatggtgatctttctcaagctaagcgaatgagcgtgttaaagagattccgtaaaggtaagctagatattttagttgcaactgatgtggcagctcgtggattagatatttctggggtaagtcatgtttataactatgatattccgcaggatccaaattcttatgttcaccgtattggtagaactggacgtgctggtcagaacggaatgtctgtaacttttgttactccaaatgaaattggctatatgcgtactatagaacaattaacgcataaaaagatgatgccacttaagccaccaactgatgaagaagcatttaaaggtcagctaagtgcagctaataaaaaggtagcagaattgcttgatagcgatctttctaaatatactgaagaagcatctcaacttcttgacgattattctgcgattgatttagtggccgctttattgaaggacttgtctaaagatgcagatagtgtaaaagtaaaaattacacctgaaaagccgttaccatttaaatcaaagcatggtaataatcgaaactttaaacgtaatttcaaacgtggtggagatcgaaatgaacgatatcatcgtaagcctagtgcccgtaaaggtggtagaaagcatgatttcgttataaagaaaaaagattaatttttgttactggagagctgtagttgctacagctcttttttgtaatataatgtatcaatgtgtgaggtgaaaataatgattagaggcgtaggaattgactcagttgaagttgaacgcatgaaaaagatagttgaaaaaggcgataaatttgctaaaagggtattaactccgaaagaatttgagcaatatcaacaattaaaaggaaagcgcaaggtagaataccttggtggacgtttttctttaaaagaatctttttcaaaggcaatggggactggattaggcaaatatgttggttttcaagatattgaaacattatgggatgatttaggacatccagtaatgacctcgactaagttttctggaaatatttttcctagtatcacacatgatgatcatgagattataacagttgtagttttggaggaattaaactaatggttccaggaattcatcgtccagccgtagtaaaggtaaacttgggcgctattaaaagaaatctgaaaaatgagatggggcatctagagcccggtcaaaagatgcttgccgttgtaaaagcaaacggctacggacacggttcagtagaagtagctagagtggcagataaggtaggagcagccggattttgcgttgcaattttagatgaagcattagagttaagacgtgcagatattacaaaaccaattttagttttaggcgttgtttctcctgaatatgctccaattgctgctgtaaataacgtctcattgactgttccaaacttagaatggcttaaagaagcagagaagtatttaaaagatgcaaatttgcaattgaagattcatttaggtattgattccggaatgggaagaatcggatttaatgaagacgcagactttattactgctaatgagtttttagagaataacgataatttctttattgaaggaatgtttgcccattttgcttctgctgatagcagtgatgaaacttatttcaaacatcaatgtgaaaaatttaatcatatgaagagcttgcttactgtaaagccaaagtggattcatgttgataatacggcagcaagtatttttcatgacggaattaaaagtgatttagttagatttggtattggaatttatggtttaaatccttcttctaatcctaattctccagatttaaaatcaaatattaagttagaacctgccttgtcatttgaaagtgaattgactcatgttaagacaattcatcaaggtgatggtgttggatacggttcgacctttgttgcagatgaagatacaattattggaaccgtacctgttggttatgcggacggatttattagaaaatttcaaggtttcaaagttaaagtgggagatacatactgtccaattgttggccgaatttgtatggatcaatttatggttaagatgcctaaaaagatgccagtagggaccaaagtaactatcatttcttctaatcctaatgatcaaaataatattaaagctgcagctgattatgttgacacaattcattatgaagtggcttgcttattaaatgatcgtttaccacgtgtatattacgaaaattaaaaataaaagcttgtttaaccaattttggctaagcaagcttttttaactacagtaattaagataattagtcttttaattcaccaggtttttctgcgctacggattgttaggcctgattgaagatcttcaatttcggcaacaacgaaacctctcttttcaagtcggttgacgatagcagtcatagtttcgcgagaaacaccaataggaagagtaaataagttacgacgaactaattcaccagttttgacatctaaagttaaacaaccggcaatattactatatttagaaataatttttgccattttaactaaattaccacggtcattatctgagaggatggtcaaaacataagaaccatttttgatgttccaagcatcagaaagcatatctagcaaacgagcgtgagttaaaattccgtagaaatgattttcttcgtccaatacagcaatgtatggaaggtctttaatgttaaagaatacacggaagaaaggtgaatttaccttaattgttttagtagcgtttttaagcaagtaagttacaggtaaattcatgtcgccgccttgagatttatgacggtaaatgtgcattttataaatgtttccacggaaaatagttcctgtatcatctaaaatagggacacaacgaaagccggagtcttctaatatttttaatgcttcggcaagagtagctttttcattgactgtagttaagtaatcttttttatagacaagagatttaattagcatgattagcctccatacatctgaaatttacaagccattataccatagttttatataaaaattaaagtctgattaaacaactttaatttagaaaataaaagagcatccacaaaatgtgaatgctcttttacagaaaaaagttgtaattattattgacgaacctttacgccagtttctttgaaggctttgtccataacttcttttaattgttttgcagaagcttccatcttagcttgttcgtcagcgttcaatggcatttcaataacttgttccaagccgtgacgaccaacaactgctggagtaccgatgtgaatatcgtgtaagccgtattcaccatccataggtactgaaagtggaagaactctgtgttcgttgttcaagatagccttagtaatgaatgctaaagcagtaccgataccgtagaaagtagcacccttcttgttaatgatgtcgtaagccatatctgcaacttccttgtggattgcttcaagcttgttttcaccaacttctgggtgagcctttacccagtcgctaacttttacgccaccaacattgttgtagctccatactgggaattcagtatcaccgtgttcaccaagcatgtatgcgttaactgaacgtgggtcaacgtgttccatttcaccgataactttttgaagacgaccagtatcaagtgaagtacctgaaccgataacacgatccttagggaatcctgacattctccaagttgcgtgagttaagatatcaactgggttagcagcaactaagaaaataccattgaaacctgattcaacgattggttcaacgattgaagataaaatctttaagttcttgttaacaaggtcaagacgagtttcacctggtttttgtggagcaccagcagaaataactactaagtcagcatcttttgcgtctgagtattctgcagagtaaatagtctttggtgcaatccaaggagtagcgtctgctaagtcaatagcatcaccttgagttctttctttaacgatatcaacgatacctaattcttgtgcgataccttgttgaactaatgagaatgcgtaagtagaacctacagcaccgtcaccaacaagaataatcttatgaattttttcttctgacatttgctaatacttccttccatattagtgatttatttaacaataacgattatatcatattggaatttaaaaattaaaaataagcaaattgcaataataaattgaacacttttagttaagctgcttgatagattagatctaattctctttcaaagatttcatctggtgtatgataggccagtatctttcttggcaaagaattgcaccaggtttcaatattaatgatgtcttgtaaagaatagttagctattgcttctcccttaggaatgaatctgcgaataagaccattgtgtctttcaactgttcccttatcacaagaagtgtaaggatgggcatagtaaaccagtgtattggatactttttctaggttggaaagatctgcaaactctgagccattatcagtggtaatggttttaaaaatatcattccaatgttcgctgtattgcctttggagttctttaaaggcctgcatgacactgacagaagtcttgtcaggaatacgaagaattaaaaactcacgactcatacgctcagataaggttagcagtacctcatcatctttgctcttatgtccgagaactaaatcgcattcccaatgaccgaattcattacgtttattgatctctttaggacgttcttcaatgcttctgccaagttttttcttatttttgcgaatacgatgaagcttagtattgcgtttaagcttctctggcaagtcgtaattataaattcctaataagccttgatcaacgtaattataaagagttttggtgcagacaacatcgctgctagcgaattcgccaacagcagtagcacgattactgcacacatcaagcgaccagccatctttaaaaaaatgcttgtggacatagcgcatgaattgagctttcctgagaaagtctgatttgcgcccacaatttttacgatgagctttatatgcatcatgcccttgagtagccttatattttttgactttaccatgatacagttttacagtgccacgcttaacctcatagctgatagtagaaggagaacagttaagttcacgggcaattgcacgcaaagaatagccatctttcaaacgcaattgaataataactcgctcttcaaatgataaatgcttgcctttaacgtgctggttcatggtagaatgtaaagagtccattttgacctccaatagaaagtttttgtggttattaacattctatcaaacaggtccgaatggactttttattttttatcaagtgttcaatttaattttacaatcagcgaaaattaaaaatataattttaaagatctaattaattatttgtaagtaagcgtgtgctataatctcaagagcaataagcagatttagaatgaaatatttatcaaagaggatgaaaaagaatgaagttaattacaggtttaggaaatccaggtagaaaatatgatcagactaagcataatacaggttttatggcattagatcattacttagagaaaaatggtttaactctagataagaataagtttgaaggcttatggacaaaacaaaagatcaacggtgaagatgtaatttttcttgaaccgcagacttttatgaacgattcgggaaaatcaatcgcgcaagtagctaatttcttcaaaattaagcctgaagatattttagttattcatgatgatatggacatgccaattggaaagattagaattcgtgcaaatggtaaatcagggggtcataatggaattaagagcattatggcttgcttaggaacgaacaattttaatcgattaaaaattggaattcgccatcctgaaaacgaaagtgttgtttcttgggtattaagtccctttaataatgaccagcaaaaactgatggatgcagcttttgagacaagtgagaatgtcattaatgattttattaaagggaagaacgcccaatatttaatgaatcagtataattagaatgaacattacagaattaataaaaaaagataaagagttaaataattttattgaaaaagctccagtagaaaaaagatcgcttttaactggagtaaattcaggtgcttttgccgctgtactgatgcaaatgctaaaagtttggcagcagccattgattttagttgaagataatgaagaaaaggcgcagacgcttttagatgaattgggaaacttattgcctgatgatatggtatttagttttccagttgatgctacaattgctacccaaacggctattgcatctccggacgaacttagtcaaagattgcagaccttagagtttttagctgaaaagagagcggggattgttgtagtaacgcctcaagctttacagtataagttgagtgatccgagagattttactaaggcaaaaaagatatttaagcctgaggcagaattcgatttagataagttaactgaatggcttacgcaggcagggtatcgcagagaaagcattgtagcccgtcctggagaatttgctcgtcgaggagatattgttgatatttatcctttggatcaagagaatccgattcgaattgaattctttggggatgaagttgataccgtaaaggagtttgattcagctacacagcgtagtttagaagaaaaagacagtatttcaattggcccagctctagatcgagtattttcaccacataattttcaagaagcggtagaaaaaataaagcaggatatgagcgaatcaattgctgaagaagagagcgttaaaaatcattttgttaaggcaattgatttattagaagctggtggtttaccagataactatgcctttttaattgattatttacttccgcgatctttcaatttaattgattatttagataaagatggcttattactatttgatgattggcagtccataaaaaagaatgtagctgatgtggatgctcaaaatgaagcttttatttccgaagaaataaaagccggagcaatgctgaatagtcaaaaattacgccatagttttgagcgagttgttcaaaaatcaaagcaagctcagattttattctcgcttttccaaaaaggaatgggccgattaaaatttgatcaaattcttaactttaccacacgagaagttcaacagttctttagtcaaatgcctttgattaaaagtgagctaacacgattttctaatgaaggaaatacggttatcttgcaagctgattcggaaactcgtgccaagcaaatcgctcaaaatttagttgattatggtgttgatattccggttgtaaaagcagatcaacttttatcaaataaagctcaaataactgtaggtaattttgcacatggttttgctttacctagtttagatttggtttatttaactgaacgagaattattcaatcaaagaccacatcaccgcaaacgtgttaagactcttgaaaatgctcaacggttaagaaactataatgaattaaaaccaggcgattatgttgttcatgtcaatcatggtattggacggtttgaaggaattaaaacattagatgtagatggtaaaaaacgtgactatatcactattacttatcaacatcatgatcagctatttgtccctgctgaccaattaggtttagtacaaaaatatgtggcttctgaaggcagagttcctcatattaataaattgggaagctctgagtggactaagactaaaaaacgggttcagtcaaaagttgaagatatcgcagatgatttgattgaactgtacgcaaaacgtgaatctgaaaaaggatttgctttcagtccggatgatgatttacaaaaagaatttgaagatgcttttccatatcctgaaactccagatcagcttcgttcaattagagaaattaaggctgatatggaaagtccgaagccaatggatcgacttttagtgggagatgtaggctttggtaaaactgaagttgccttgagagctgcttttaaagcaattcgggatggaaaacaagttgcctttttagctccaactactattttggcgcaacaacattttgaaaccatgcaagaccgctttaaagattttccagtcaattgtgcgcttttatcacgttttcaaactcctgctgaagtgaaggagatagttgaaggtgtaaaaagtggcaagattgatatggtcgttggaacacaccgcttgctctcaaaagatgtccaatttaaagacctaggcttgttaattattgatgaagaacagcgatttggagttaagcataaggaaaggctaaaagaattaaaagccaatatcgatgttttgactttgactgctactccaatccctcgtactttacatatgtcgatggtaggagtacgagatctttcagttatggagacgccacctactaaccgttatccaattcaaacttatgttatggaagaaatgccaagtattgttcgtgaggccgtccttagagaaatgaaacgtaacgggcaagtatttttcttacataatcggattgatgatatcgataaagttgttagtcaattggaagaactgattccagaagctaaaattgaatatattcatggtcgcatgagtgaaaatcaaatggaagatattatgtatcgtttttcaaaaaacgaatttgatatcttggtaacaacaacaattattgaaacgggcgttgatatgccaaatgttaatactatgattgttgaagatgcagatcattatggattaagtcagctatatcaattacgtggtcgaataggcagaagtgcccgtttagcctatgcctatttcctttatcaaccaaataaagtcttaactgagattggtgaaaaacggcttagtgcaatccgcgactttaccgaattaggatcaggctttaaaattgccatgcgtgacttatcaattcgaggagccggtaatatgcttggaaaacagcagcatggcttcattgatagtgtcggctatgatttatatgctcaaatgctagacgaagcaattaagaaacgtaaaggtaaaaaagttgcggttaaatctaatgcagaagttcaatttaatttggaagcttatattccagatgattatattgcggatcaagaacaaaaaattgaattctataaaaaaattaaggggatcaatcatcaaaaagaggcagacaatatcgcagacgaattaattgatcgctttggtgattatccacttgctgtagaaaaccttttgaatgtatctacgattaaggcagatgcagatttagctcaggttgtgtcccttactcaaaaatcagatgataagttacaagtcatttttaataatcaggcgagtgaggaattagaagggccgaatatttttaaggccttagaacatgtttctctaagagcacgaattaatatggatccgcaaaagagattgaatgtaatgcttgagcttgagaaaaatatgagtactagacaattatttaatgagcttcatacattcttagaagcagctagtgagattgttcaaaaataaggagaatagagaaaataatgagaatcgataagtttttaaaggtatctagattagtgaaaagacgtactgttgctaaagaaatggctgatcaaggaagagtaaaggttaatgaccgagtagtaaaatctagttatgatgttaagttagacgatgttattgaaatcggattcggtactaaacaattgaaagctcgtgttcttgacttaagagaaacaactaagaaggcagaagccagcgacttgtatgagctaattgattaatgacaagggaagagtaaggtgttatattaataacaagtggtgatataattaagatttagaatattaacgaaaaggcagggacataagtatgcagagagggccacgactttataatgccttaagcgatgaagaacgcctagcacgtttgcgacgtaaagcagctagaaaagaaaaagaggttcatcgtgtaaggaagaaccgaattattgcttgttttgcaattgcaattttaatttttggactgcaattaattatggtccatgtgcaaactggtagaattaacagtcaaattcaaactaataaagcagagttaaaccaggttaacaaaaccaataaaaaattaaaatcacaggttgcagacttaaaagatcctgattatgtggctaaagtaattcgctataagttctattattctaaatctggtgaatcaatttatactcttcctgaaaaagaggaggattattagtgaaatttccaattggattaaggctcaatgctaaagtgaataatattactaaacttgggatttttgtaactttaccacatcgacatcatggtttgattttccataaagacttcggtgataagtgggaaagtgctaaaaagaagtatagtgttggagacgaaatccgtgttgtcgtgatcaataatcatgaaggaaaaatttctctatcattgagtcaggtaaataattctgatttagttgatccaactaatgaatttaaagatagcaaagattttactccactagctaaattattagagaaatctactgataaaatagctaatttaaaaaatcaattgaatttaagtgaccggtaggggtcacttttttaatctaaaaatgacaaaatttacaactttttttactgaaaataatattgaaataaaaaataaaaaatttttactggctgcaagcggcggtccagattcagtagcgttgctgaagatgttggttaattttttacctaatccatctgaacaattgattgttgcacatttggaccattgtctaagagatgatagctttttagaaagccaacttttacaaagattaacttcagcccttaaagtaaagctagtagaaaaaaagtggccagttgaacttcatccgcaagctggggttgaagcaaaagcgagagagtaccgttatgcattcctggcaaaggttggaagaaagtatcaaactgattatcttttaacagcacatcacggggatgatttaattgaaaatattttattgaagtttattcgctctggggatgtagctgaaatgaatagtcttcaaattgtgggaaatctcggttcaatgaaattgttgcgccctttagttaaatattctaaagatgaattattgaaatatgataaggaccaccatcttgatttcattgaagataaaactaattttgaagatgacactttaagaaatcgtttgagacatcatgttgttccattattaaagaaagagacaagtcatctagttaaaaatgctaaccactttagtgagagtgtagcattactttcaaagtgtcagagtgatctctttgatagtttaccttctccaataaattttagtaaagcgctacggggtaaaaaggaagatatagctcggttaaatacacatgaagcggcagctttttttgattatttaatctataaaaagtggcatcaaagaatccattttgatgaaattgacttgaataaaaatgtgattttcaataaagaaaattttcaattgcttttttatcaaaaatattactatttgattaatagaaatgaattagctgtaattgatcctaaaagaaaactagttaaattaaatgaaaaattttcttttaacggaaaaaaatatttaattacccaggatgaaaagtcacaaaaattggctggttatttttatggcgaaaaagcaaagtatttagaggtagggagcttgccacaaggtagtacattaaagttagctacaggaaaacaaactaaggctaagaaaaaatttgctgaaaatgggattcctttagctttaaggccgtattgtttgacagtctggcaagaggaaaatccagtctatgttgaaagtgtttatcaaaatcaagaatataaccccaattttatacgctataatgtatatatttatttttaagtttatgcaaagttctatggtaaaagcataatttgtggtaaaatcgttggagtaattccaagaagtgtcgcggaggttaatagatgaaaaatagaagaaatagactgctttctaacggtcttttctatatcatagtattcgtgatcctcttggctggaatcaattgggccgtgggaggctccggtagtaatggttccacagaaaatatccgttattctcaattagtaaaagatttaaaagcgggtaaagtcaagagtatcaatgtacaaccatctaatggtgtatatacggttactggatcttataagaaagctcaaaagtcaaataatcaaaataataatggatttggactaattccaagttcacaaagtagtaatgaagtaacccggttcagtactacgatgcttcaaaatgactcaatggttaagacaatttccgatcttgcccaaaagagtggggcatctatttctggacaaggtgaatctcaatctggaacctggatctctacgattgtgatgcttgtcccaactttgatttttattgtcatgctttggatgatgatgaatcaaggtggacaaggccgtggcggcggtatgatgaactttggtaagtcacatgttaagccacaagatccaagtaaaaacaaggttagattctcagatgtagctggcgaagaagaagaaaagcaagaattggttgaaattgttgaattcttaaagagtccagcaaaatatactaaattaggtgctcgaattccggctggtgttcttcttgagggtcctccaggtactggtaaaactttacttgcacgtgcagttgcaggtgaagccggtgtaccattttattcaatttctggttcagactttgtagaaatgtttgtcggtgttggtgcatctcgtgtacgtgatctgtttgaaacagctaagaaaaatgcaccaagtatcatctttattgatgaaattgatgctgttggacgtaaacgtggtaatggcgtaagtggtggccatgacgaaagagaacaaactttaaaccaattactggttgaaatggatggtttcgaaggtgatgaaggtgtcattgttatggcagctactaaccgttctgatgttcttgatcccgcacttcttcgtcctggtcgttttgaccgtaaggttttagttggtcgcccagatgttaaaggccgtgaagctattttaaaggttcatgctaagaataaacctttagcccctgatgttgatttaaagaaagtagcacgtcaaactcctggcttcgttggtgctgatcttgaaaatgttttgaacgaagctgctttagttgctgctcgtcgtaataagactgaaattacagcttctgatattgatgaagctgaagatagagttattgccggcccagctaagaaagatactgttatttctccagaagaaagaaaacgtgttgcctaccacgaagcaggacacgcaattgttggattggttcttagtgattcaagaactgttcgtaaggttacaattgttcctagaggccgtgctggtggatataacatcatgcttccaaaagaagatgaaaacatcatcactaagaagcagttgatggaacaagttgctggtttaatgggtggtcgtgctggtgaagaagtagttgtgggcgataagtctactggtgcttcaaatgactttgaacaagcaactaacatcgctcggggtatggttactcaatatggtatgactgatgttggtatgactgagcttgaatctccaagtatgcaatcaccttatggaactaagccatatagtgaagctacagctgctaagattgatgaagcagttaaagaaattcttgatgaaggtcataaacaagccgttgatatcattaagagtcaccgtgaaactcataagattattgctgaagccttactcaagtatgaaactttaaacgaaaaacaaattctttcattattcaagactggtaaaatgcctgaaaatgatgaaaatgaatttccaagtgagtctaaagcttcaacttatgaagaggcaaaagctgcaatggaaaagaaggatcaacaaagagaagaaactgaaaacaaggatgataaagaagatattcatccacttcctgatgatcataagaatattgataatattcctcttaatccaccatctgaaaagaatgaatctgatgatcatagttcagatgaaaacaaggatgattaagagtttattgtaagagtgatgtttaaactcctttctaatactgaaattacagattttagaaaggagttttttggtattaagaatgaaatatttaagtaaaaaagaaaaaaagattttaaaggtaagcctaataagttgtttaacaactatagttctctttttccttttatctactttgaccgattgtaacccaatctttgggggagttctgtatagtggggatttaccaaatcaatatttgtccttctttcaatattatcgtcatttaatgctcggtaattggagtagcgcaggatttagttttctcaatggtttgggtggagatatggccggaaatattggctattatcttcttagcccactcaattttattgtgttccttttcccagcaagtaaaatgaatattgctgtgtatattattatcctgatcaaattaggtttaatgagtggaacctttacttggctgactctgaaatggtttaagtttaagtatcaagcatatcctgtctttttaggaattgcttacggcttgagcggctattcgattgcctatgctggaaatgtaatgtggtttgatggtttagtcttacttccgttaatttcctatgcattgatcagaggaatcaggaagaatgtttggctggcttacagtattttactagcatgtgctatcatttttaattactatattggctacatgatttgtatctttttagtaatattgtttttggcatatacagttaacaattttgaaaatcgcaaaacttttcttcatcaatttaccggttttgcaattagttcaatcattagtgggttaatcagcgcagtagttattctaccaactttctttaacctttctagcaataagttgtctcaggcagactttaattctaattttgaaattaaaactttaattagtggcggaaaagctgtttcacgattatttattggcgatacttacaatgattgggcaccaatttttgttggtacgttagttttaattgtatttattctttactttattgatggacgtaactctatcaaagaaagaattactaatctagttattggactattttttgtgttgagtattactgtgccaaaaatctatctcttttggcatggtggtcaacaaactattgcttatccatatcgttttggatttattattgtattctggtttttacttttggcggcaaaagaactctctaatttaagtgagtatcgaaaagaaagtaaaaacgaaagactcattgctgctggaatttacttacttgttagtttagcagctgtatatattcgtcgtagaattggaccatggaatggttatgcttggctggcagttgtcctagtaattatatttggaatcttggtttatttctctgataaacgatttgttcgtgtaactttattattggtaggattagttgaattagccggtaatgcctatattgggttgaatcatctcggaatgaaaagtggagcatatccatcttatgtgtctgagaatcagagtattatttctcgaattccaaattctgataaaacgggtagattggctaaaaactatgaactaaataatgatcgcggtgagggatacacttttaattaccgggggatggaagaattttcatcaaataatgattctcgcattagttcattaatgactgatcttggtttttcaacttttcgttatttctactattatcaaacaggtactgtagtaacagatgctatttttaatgtaaaaacgtttattaatagttcgctttctaatcaaagtgtttcaccagaatacattagctatggtttgagaaatgatttaaagaatcatcctgtaattctaaaacagggtgataagacggcctatcgaaatgaaactttaccttttgcctttgcaggtggtttagctaataagctgaagtttaaagaagaaaatccagtatataatcaaaatttggttttaaattctttaactcaaactaaaaaagatgttttgagctatagctctaaaaatgctgaaattaattctaagaatataaatcttaaatttaagaaaggtaagtttaaagctaagagaacttccgaaaatcctggtactataacctttacatatagcaatttgaaacctgatcaagttggttatatccgctttagtaagaatttaatggagcagattgtggttttaaatagctatcaaatgaagcaaaagccggattaccgtttaccatttactgtctcaattaatggaaaagatgttcatcttcaacaatacacagatcaacttattggagttcaagctgataaagacggaaaactggtagtgaagatgactttagacggaaagtcaaatgaagttgagtttaaatatccacgttttgtgaatattgatcaaactgcattagaagataaggttaaaaaagctcaaaataatcgcatgaagttttctgcgtttagggatagctatgtagctggaacagtaaagactgataaaaatgaaaacttagcaaccaccattccttacagtaaaggatggcgagcagaagttgacggaaaaccagttaaaattaatcgaactttgaaagtgtttattggcttaaaattaaagccgggaacgcatcaaataactttcaaatatagaacacctggttttgtcatcggtgctttactaagcattatcggtattattgccttagctgtatatacggtctatctaaagaaaaataaaacatctattagtcagaaaactaataaataggtgaaataaagattgtacacccctctaaaattagaggggtgtatttagaattaaggataataatgaaaaagttgagtaaagaaaagaaaaatattctgaaactgtgtttgataagtttcggaataactatagcgattttcctaattgtatctagtttggcaaattgtaatccgtttttaggtggagttttatggggtggagatttaccagatgaatatctgtcattttttcaatatcttcgtcgtttgattttaggaaactggagtagtttgcaatttagttttgctaatgggttaggcgcggatatggctggaaacattggttactatcttgctagcccatttaatttactaattttgttattcccagctagtcaaataaatttagcactttatgtaataattattatcaaattaggtttagctagtgcagcatttacatttttaatcttaaattttttcaattttaaaaatcagatctattcagtttttctgggaattatttatggattaagtggatactgcatcggatatggagcaaatttaatgtggctcgatggagtaatcctattaccattaattatttacgctctgatcaaaggtttggttaaaagacactggactctttatattgtcttgctagcatgtgccataatttttaactattatattggctacatgatttgtatcttcatggtaattgccttttgtgcttatacaatcaataattttaaggataaaaaaatattcatccagcagataattgattttgtaataagttcactaattagtgggctaattagtgcggttattactttaccaacctggatgaatctatctaataataaatttgctgaacacactatcaatgaaggttttagactaagtccagtttcttcaattgctaaaagcatatctgctctctttatgaaaaatacctttaatggatcgccccttttatttattggtactttagcaataattatttttattttgtactttattgataataagaattcaaaaaaagaaagaattattaacttagtgattggtttagtttttctactaagtttggttcaaacaaaaatctatcttttctggcatggaggacaaaaaccagttggttttccatatagatttagttttattattatcttttggattttattattagctgcaaaagaattagcaggttttgatttaaagaaaaaacaacttctattagcatcaggaatctacttcgttgttggacttttagtgactgtcttaagactgcactatggaaaatacgatatgtatatgttggtttcgctgggcttaattattttgtttagtattttactttatttttcagaccataaatcatttcgttttgttctcgtgatggtaggagtagtagagattgctattagtagttatcttatgttggatcgaatagggatgagaagtaatatatactctaattatgtaactgaaaaccaagagttatttgatcatttgccagctagtgttaaaagtaaaagaatagccaaaaattattttttaaataatgatcgtggcgaaagctacgcatttaactacaaaggagcagagattttttcttctaataatgatcccaaaattagtaaattatatgctaacttaggattatcagcatatggttattattatttctataaaaccggaacagtagtgactgatgctattttcaatattggtggttttattgataattccttaccaagtcagagtatctcccctgaatatattagttatgggctgagagatgatttgaaaaataatccaattttattaaaagaaaagcagtacacagcatatcgaactgatacattaccacttgtttttgctggtaatttatctaataatttaaaatttaagagtgatgatcctgtttataatcaaaatctagttttaaattcattaactcaaactcaaggaaatgtcttaacttatagtccaaaagttgcaaaaattaaagtaactgatagtaagttgaatcaggaaaagaagaagtttacagttactcggacatctgataaagagggaagtgtaacttttacttttgacggtttgaagccaaaagaaacggcctatgttcaatttggtaaagatttaatgggatttgcggatccactaactacttatcatgcaagtcaggatggaaataataagcctgaattaagcattaccgttaataaaaaagatgttcgacttcaaccacaagttaaacaactaattggtgttcgagcaaatcaaaaaggacaggtccaaattaagtggagcctagcaggaaataaacgaattctgactagtgaaatgccacgtttagtaaatattaattcaactttattgcgctctaaagtctcacaagttaataataaaaaacagatgcacttaacaacttttagagataattatctatcaggaaaaataaataccactaaaaacgaaaatctggtaactactattccatacagtaggggctggaaagtaaaagtagatggtaaaccaattaaagtgagccgaactttggatgtatttattggtttaaatatgaaacctggtaaacatactgtagtaatgagatataggactcccggattgcttattggagttataacaagtatcataggtataatcttactagtggtatttaatgggtacttggaaaagaaaaaatattagtcaaagaataaagtctataatttataggctttattttttaggaggaagaaaaaatgaaagattatttagtaaaagcaattgataaaactaaaaatttacgattaattacggttgatgctaaagatttagtaagtgaagcacaaaaaagacatgatacttggagtgcatcttcagctgtgcttggaagaacacttattggaggattactcttgtcagcagctttattgaaagataaagatgaattaactgttaggttacttggaaatggtccagtgggagcaactattgtaacagcaaaagctgatctaacaattaaaggatatatccaaaatcctcatatagcccttccacctaaaaaagatggacatatcgatgtggcaaaagccgttggaaaagattggcttgaggtaaccaaagatcaaggtttgaaggaaccatatacaggtcaagttccaattgttagtggggagattgcagaagattttacatattatctagccaaatcagagcaaattccttcagctgttggtctatcagtatttgttgagcctaataatgagattggggcagctggcggatttattttacaggcattacctggagctactgatgagcaattggctgaagttgaaaagagaatcaaggctcttcctaatctttctactttatttttagatggaatgacacctgaaaatttggcagagagaatcttagggactgattgtaaaattttagctaaagaagatgtttcttttgcttgtgattgttcgaaagaaaaatatagtcaaatcttggctaccttaaaaccagcacaattaaaagaaatgattgagaaggatcatggcgcagagttagtttgtcgcttttgtaaagaaaaatatcattttactgaagatgagttaaaagatgtccttaagaaggcaaattaaagtggtgtgtaatgaatagttttgctatgatattagggtatttgaaagggtgagcaagtgtgaaaaacgatagttggaaaattagggatgttgaaattcctaatcgtgtagtagttgcaccgatggctggaatttcaaatgctgctttccgagtagtatgtaaagaatttggtgcaggcctagtagtgtgtgaaatgatttcagatcatggaattatttatcgcaataaaaagaccttggaaatgttaacggttgatcctcgtgaacatccaatgagtattcaaatttttggtggtagtgaggaaactttagttgaagctgctcattatgttgatactcatacagcagctgatattatcaatattaatatgggttgtcctgtaccaaaggtaacaaaaactgatgccggagctcgttggctattagatccaaataagatctatcaaatggtccatgcagttgttcgtaatgtaagtaaaccagttactgttaaaatgagaacaggctgggatcaaaaacatatttttgctgttgaaaatgctttagctgctcaagaagcaggtgctagtgctgttgctatgcatggccggactagaaagcaaatgtacatgggcgaagctgactgggaaactttgaaggatgtagcagatgctttgactattccttttgttggtaatggggatgttactactcctgaaaaggcaaaagcaatgttagaagatgttggagcagatgcagtgatggttggtagagcggctttagggaatccatggattattaaagatatggttcactatttggataccggagagaaactacgtccacaaactgttgaagaaaaagtagaaactgctaaagatcaattaaatagattgattgatttaaagggagaaaaaattgctgttcccgaatttagaagacaagcagcttattatttaaaaggaattccccgttcagctcgaacccgtgctaaaataaatgatgtttggacgaaaaaagaagtttttgacttgttagatgattttgtggaaaaatatgaagcgagacaaaagcaaattaaccaataaaaggagtttttagagtggcaaagaatgaaatgaacgaccaactaatcgctcgtcgtgaaaaaatggacgaaatgcgtgaaaacggtattgaaccttttggcgtaagaaaatttgatcgtcaagacttagctcgtactttgaatgaaaagtatagtaatgaagataaagatgaattaaatgctgatatgcctatgactaagattgcaggtcgtatgcttgcaaaacgtggtaagggtaaagttggatttgcagatctttatgaccgtactggtaaaattcaaatttacgtacgtaaagatatcgttggtgaagataactacaagatttttaagaagtctgatattggtgactttttaggtattgatggtgaagtaatgaagaccgatactggtgagttgactattcgtgctactcacattactttcttgtctaaggctcttcgtccattgcctaataaatgggatggtttaaaggatgttgaacaaatttatcgtcagcgctaccttgacttaattacaaatcatgatagttacatgcgttttgttcaccgtactcaaattattcaagctattcgtgactatttgaataatagagatttcttagaagttgaaactccagttctccacaatattcctggtggtgctgaagctcgtccatttattactcaccacaatgctttggatattgatctttacatgagaattgctttggaacttccattgaagcgtttaattgttggtggtatggaacgtgtttatgaaatcggccgtgtatttagaaatgaaggtcttgatactaagcacaacccagaatttactgaacttgaaacttatgcagcttactgggacttccatgatgtaatggatgaggcagaaggaattattagagcagctgctaaagttgtttcaccagatggtaagattacttaccaaggaactgatattgacttaggtaagccattccgccgtgttcacatggttgatttaatcaaggaaaagactggtgttgacttctggaagccaatgactattgaagaagcaagaaaagttgctgatgaacacaacgttcactatgaaagctactggaaggttggccacattattaatgccttctttgaagaattcggtgaaggatcaattgttcaacctacttttgtttatggacacccagtagaagtatcaccacttgctaagaagaatgctgatgatccaagatttactgatcgttttgaaatcttcattatgggtgcagaatatggtaatgcattctcagaattaaatgatccagatgatcaacgtcatcgtttcgaagaccaaatggctgaaagagaagctggtaacgatgaagcagatatgattgatgaggattaccttcgtgctatggaattcggtatgcctcctacaggtggtctaggtattggtattgatcgtttggtaatgcttttaactgatgctcctgctattcgtgatgtcttactcttcccaacaatgcgccctgaaaaggttgaaagtgttgaagcagaagttcaagaagatttgaagaaaaagaacaaatagtttttgctaaatagactgtcgtaaatgacggtctatttttttaatattttttcaaaaaatacttgcaataaaaagatgttttgctatactaataaatgtactgcggaagtagttcagtggtagaacatcaccttgccatggtgggggtcgcgggttcgaatcccgtcttccgctccagtataaaagactcaccgaagtgtgagtcttttttgttattcgggatgtggctcagcttggtagagcgctacgttcgggacgtagaagtcgcaggttcaaatcctgtactctccttatttgattaaaagaatgttgatatagcaacgtttagaacactaaaaatactagaatggtaacattttggtaacataaagaaaaaatgcatccggaagggtgcattttctttatatatttaattgttttaatgcattaactgcatcttctttatttttattatttacatgcgtataaatatctaaagtcatttggatattttcatgaccaagcagcatttgaacagttttaggttttacattagtttccgcaataagtagtgttgcaaaagtatgtctaaagccatgaactgttatatgacgtaaatcaggttgtggttcttttaagttgtgtgtttttgcatacttaactttttcctcatgatctttagcataaattgatttaagccattgatctggtttgctcatttttaaatacgttcctttaattgtgtgaaagagcttgttagagatgattttttgcttttgcttataatctatcaaaacttcttttaaactgtccgagatgggcaaaatacgcttagatttaggtgatttaggtggctggataattgttttattgtctaaaccatatgccaaggttttatttatggataaagtacctgcttttaaatcaatatcttgccaagtcaaagctaatgcttcggattttctaagaccggtagcagaaaggagcttgaagtaagtatattgaactaatccatactctttagccacttcaagaaattgatttagttcctctcgtgtataaacattatgttcggtatctctacgtggtcgagatgtctttttagggataatgatccgctttaaaggattttcagacacatagtttaaccgaataccatattcaaaaagagcattaaattcattaatagcatccctatatttaacaatttgttttgctttcctatcagcccacttttgtaattcagctactgtaatcttgtcaacgtattggttaccaaaatccggaataacatggttatcaaagacctgcttatttttattcgcagtagattcttttacctgagttttatagttttcaaaccatagatcacgtaattcagaaactttaatctgtttttgttttacaaaattatctggtttagtttgagataatttgttgaatactgcttctgcttcagcataggttttaaaaccacgccgatgaacttgaactcggtcaccattgctgttttgacccagtgaaataacaaattcatatcgtttctttccagattttaatttataatctttgatactggtgttttttctttttggcataataaaaaacctcctattgtagtctaaatgtgaactctgctacaataatagggcagagttcatatttttatggctttgttaatcgaatttatgttgagctattgacgtagctcatttcttcccactgatgttggcgcatcggtgggattttttatttacttagataaattatctacagcatattgtgcttcttctggagtaaatttgtccccagaattagaagttaattgatctttaatttctgctgtagacatattcatatctttttggtaagttttagcactttctaaagcatttttattccaatcagctttaacatgatcaacagcatattttgcagcatcttctgggaatttatctccagatttggaaattagttgatcataaattgcggccttagacatatgcatatcgtttgcgtatgtttcagcgcttcctaaagcagcggtaaattctcccgaaactttaggtttagtagatgatttctgcgattgagcctttgaagaagttttttccactttatcagaacttgatgaagagtcgtcatcagagccactcccgagtgcaccaccaatgactacaactaaaacaacaactacaatccaaaaccatgctcttttgtagaatggtttttgctctacataaacttttccatcttcgccggttatcttcttactcatattttcctccctgtgagtatataaaaatcagcttttagagtcttcagtatctttggacaatgaacctatagagtgaaacttaaggtgctaaactaatcttcagcagcttctttttcctttgataccggataaggatgttttttgtagccttgtttaccccaaggacaaccaatagagtaggcgatcattaatccaattccaaagccacctgcattactgatgccacttgcaaaagcaaaaagaacgttcaatccaattattataaagaaaataatcttaacaattcgttccgcttttttgtttggtggagtttttaatgtaacaaaataccagattgctaatcctacaccccaagcagagaaccaatacaagaagccttgatagtctcttacaattccaaacatagcaacgctactaacagattgagcttctacaaatccaaagaaagctccaagtgccaagaaaatagcacctactaatcttctaacattcaaagtgttttctttattcacttttaaacctccatgatttgccttaagtttaatgtcattggcattgtggacaataaaatattttgggataaaaagaggcatgcaatatatttcgagaagaaatactcgcatgcctcgctcatcaatctgagcaaaaacctaaagaccactttcatggtagacattccgctgtctatataataattattacacacgaatatttttattctagtattaaacaatcatgcaattaattctttaacaacgctatcgcgtttagtaaatggaactgatttaatatctttttctgaaaatagttcttcaatttcaggtttaatttgtacttccttatcgtttgaagaaatatcatttagaaatacataaaatgtggaattttcacgtatttctcttgtttgaagaatgtcagttagcgccgcttttgcgaataatgagttatttggattagatagagtttttataaaacgtgtaggaatatctttatagccagaaattaagtaatcaaaattaaatgtgataccacttgtaccgggaatagagatatcttctgtagcacgaatatgattttcttccagaaatgatcctacatcctcaaaaaatagggactttgtagtattttttgaaagcatgaacatatcattaactgctagaatagcttgtaataatctgttctttgcagttggaaaatatttatattctacagtagtagttaattctccatctttttcagtaataccaaacgcattaagtctattagtaaaaatcctttttctatttttagatcttgaaatagttactccattactctttaagttatctagcgtccagccatcatcagtaagagtaatactattgtttttattcttgatagcatacataactatttcatcagaaaatgagtctaagaaaggaacttcaattctaataacgttttgtgaaagatctttaaactttgcttcttttttataccagttaacgtagtcagttaagagcttgtcggctagtgtcatttttatcagtccttatatgaacgaactgtaaaaacttttcaatggcattttcaagttcgtcatttgaattaaaaatataatcatctaaaggatatgcatatgaaacaatgctgttattgacatatctatataaatgaatgtgatttccttctacaattgtaccatcatagttgtgatgtctagttccgtttatgcacagtctaactaaatgtgcattattttgtttaaagcgaatatggagagagtacttagtatctagacgtcctttatatccgtgccaaacatactttaaattgctactttctcctaatacaatgtgatcctcattgaatttaccaagtggaacgttaagagtaaaactttcaaaaaaatgtttagcttcatctatcagttcatctacttcattatcgcttagcttttctaaatccattaattaattctctctatccttttattatttacaacttactagtaaattgaattgctttatctatgattttctttgaatactcaagcttgttcctcaagtaagtagtagcaatctctagggatgccgaaagcttgagcaaaggtgtacatattatagaagtaaatatcgtgtaagtcgcaatattcagttaaaagatacaagctgaactcatttgcttctcgttctaggcgaatactgtttaccgaactagaatggtattcgcttttttcgtgtcctagaaatagatggcctaactcatgaccaataataaaaggaatttcatctatatttttccagttagcattaattacagcggtgcgatactcaggaaaggcctcagatggatcatcgttttcagcagcgtaagagaaggtgactccatattggtgatctaaagcgtaattcattaaccacctaattacttgatttctagctgctgttttctgttcaggtgtttggtacatgggctattggtccttttttggaagattatgtttttctgcgtactgttgggcaagtaagcggaaagtatcgtttaaatcctccgagataactcctttgtagggcagaccaagatcttcgtaaccaagttctttttttgaagaaggcatagataggtcaagcaacgaatcagaagaaatgttaaaagctttagctaatgcttttaattcatcactagataccttacgagtgcctcgctctattttgtttaaggcagtacgttctatgcctgttttttctgatagttctatttgtgacatattacgatcttcacgtaaattaatgatcttttttgcaagagttattctatcatctatcattttatccaccttgtttattgcgcttttcgcaataaatataacactttttgtgcttttttagtactttttttctaaaatagcacaaaaaaatgttgacagtgcgaaaatcgcaatgtattataataaatgtaaattgaattgcgaaaatcgcaagttaaacagaggtgagaaaatgactaaagcaataaatcttcctttgattaaagctaccagattaagactggggtatacaaatgaagaaatggcgtctgccttgggattaagtggtgcagataagtattatcgtagagaacaaggggaatacaattttaaagcgactgaattaccagccttatcacacgttttacatattccgcttgaaaaaatttttacttaaatttgtgcgattatagcacaatagagggagaagaattatgaaagatttaattcaaataaaagtagaaaacgatcagcaactagtaagtgcacgagatttacataaagctttagggtttaaaaagaaattcagtggatggtgggagcaaaaccaagatcagtttgaaaaaggtattgatttcaacgaggtaccaaaaggttacatcgttgaaagtggcaatggaacaacgagagcatatgacgattattggttaacagttgataccgctaaagaactttgcatgatgtctagaactgaaaaaggtaagacaatcagaaaatatttcattcaagtcgaaaagaattggaactcaccagaaatggtaatgaacagagcgttgcaaatctcgaaggctagggtcgaaaagctggaagcagataataaaagcctttctttacaacttgaagaaagcaataagaaggctagctatttagacatcatcttaggaacaccagatgcattagcgattacgcagattgccgctgattatggttatggtgcagtaaacttcaacaaacttctaaaacaagttggtattcagcataaagttaatggccaatggattctttacaaggtctatatgggtaaaggctatgtagtaagtcaagctttcacttttaaagatcatttaggtaaagacagaagcaagacaactacttattggactcagaaggggagaaagcttatctacgatgtgcttaaagataacgatactctgccgttaattgaacgtgacgatattgcataggggacgtaatcatgaaaatgaaaaaggatgatctaactattaaagcctttatttataccgaaaggaaccacaatatgtcgtggcaaagagtggaagaggtattacaaattaaaaatataagtttaaagagtctatctatcaaatccggtcttaactatgaaaaccttaggaattatcgatataagcactatgaacctactttcaagacaatgtgtaagattgctgacgctttgggagttagtcttgatgaattgagaggagataaggatgaagttaacactagaaggtaaatcggaagaaattcaagatattctaagttttatccatcttcagcaagaaacttatcttgctgtaaagggagtagatagagctagtaaggaaagtactttgattcattaaaaaggagatgatttcatgcaaatcgcaatcccagaacgagttattgaaagagctattcaacagaagtattttaacgtgacggcatcagcaaacttcttaggagttagtccatctacatttagaatttggctgaaaaagtttgattttaagccaattagtattgatggccaaatcttatatgacaaggatgtcttacaaaaatttatggaggatcacaaactatgagtaaatggattaaccacaagatcaacgaattcatggggactgatttcacagtacgtgaaacagaaatacttgcgctaggtaccatgtgtacagcattagtagcacttatttttacgatgtatacagccatttttcctaatatttaagtaaggtgatgaaaaaatatgattaaaaacaaaaaatacagggatccatttaaaggtatgagctttaatggaaaccctgtatcaaaaaaaagaatatattgcagcttatgaaaactacgttaaacgttgttctggcgaagccaaagattagttctaaaggaggtgagaaagatgacattagaagcaagattaatcagcaatagcaacgcattttttgcaagacaagataagtcaccgctagtagctgacgaatacgaaaagcaattcaaaattgcgttaatgcaacaaaaaaagtcgttactgactggcatcagtaacgactaattcaaaggtttaaaaatttaatttatctataaggagtataccacatgaaagagtttgatcctagagatctctggaaactacaagaagttaacggaatggttttaagagatatacatggcattgatgtagctattggaaaaggctttgaatacaagaatattaaagctttcattgaagtttatacaactgaatatggtgttaaagatttcatggaaaaaatgggctttgaaaatagtgaagactttactaaatattattttaaagagtttcccgatgaatgtgattggtacgatgcttgttattgggcatttaacgggatatatgctgacgatttagcactaaaaggatacgaggaagaagcctatttagatgcagaagatgcaaaaagagaccgcttagcaggtaaataaaggagactactatgagaactactgtcacaaaagaattaattaaatttgataatgaagaattaccgatcaatttagaacctgcaaaaatttattttccaaaatatgaagaactaaagaagcgagttgataggctgaccgatagtttaaaggactatgtagttacagaagactcatacgaacaagataaaaaagtaagagctgaattaaatcgcattcagaaaatgctaagtaaaaaaagaatagaaatttttaatgaagctgtcgagcctgctaatgaatttaaacaacatgtatctggcttggaaaagcaaataaagtgtgcatcggaccgaataagtgaaggaattaaacattataccgataaagaaaaagatgcaaaatttcaagaaacaaagcttcgactaggaaagcttgctcttaaatataatgtttcaattcgactattaggagatattcgagaaaaagataatcaattcaatcattggcttaataagtcttgttcttggaaaagaattgaaactgaagctgagaatttctttaaatcagaagctgagaaagcaactgctaaagcagatgcacagaaagtaattatcaataaagctaacaatccattatttaaatcagcactaccgatttctccttatttagagatgttggattacaaatctctaccagacgtcttaaatcaaatggacaatgatttagagagtgtaaagaaacaaaaaaagcaacagaaaaaagctatgcaagacataaaaaaacatggtgaccagtatatagacactaatactggcgaggtagttgatacagttcatagtatgaccattaaattttcgggcactatagaacaatttaaagcattacttcagtatgccgaaagtaacaacattagctatgagagggtgaaataacgatggaattacttaatcagccgacaccaccaatctctagtcctcaggccgtcggattaatgaatatccaaactatagtaggtatggatgctaaacaatctctagatgccaaattatccttattaaatgactttgtagagatgaaaagggtacttgcccagccttctaaaagcaaagatggctatggctataaatatgctgatttgaacgatgtcttgtcagtcattcaacaagcaatcggagatttagatttatccttcattcagcaaccaattaacaaaacagctaaaacaggggtggaaaactatgtatttaatagcaaaggagcaatccttgattttggaagttacatgctagatattacgaagcctcaagcacaacaatatggctcagcactaacctattgtcgtcggtattccattagtagcatttttggaattgcatctgaagaagatactgatgctaaagctttgccccaatatatgagtcctgaagaaattgatcgattaacacttccttacaagggaaaacaagtttcattagctaagttgttttctctagggttagctggtgattcaaaagctaaagctaagttacttgatcgagaaaataataatgttaccaagttagcagttaaaagtatgactgatatgtgggatttctcaaaagatatagaggccatgaagattaatgaacagactgaaattaaagctagcaaagatcaagaagaaaaagcgaagcaagctgctttgaataaggttcaaaaaggtaagaaagatccgtttgaggataagaaagtagaatctgattctgatcctgaagtagacaaattgttttaggtgatagtaatggtaaaaatcaaaaaggtatacgacaaacattacactgtcataaataactcggttctcaatgatgtatcgcttaagtgtgaggataaggggctgttcacatatctatggtctcaagccgatgagtgggatttttatgcaaaagaagtagcaaagcatagtgctgatagcgaagataagatctataaaatacttcgaaaactagaagaacatggctatctactaagagagcgacaaagaaatagtaaagggcagcttaaagctaataagtggtatttatctgaaactcctaaacagaaatggataaatatttttaaaaaacgttccactacaaataaaaagcctattcggcaaaatccaaaacaggtaaaaccagatctggaaaaacctaatatggaaaaaacggatctaacaagtactaactgtaacaaatacttatctaaacaagtaaagaacttaaataaatctctctctaagggagagagggagagagataagggaatagtaaaaatgttactaaattatctcgacatctttgctgagcagtggcacagcaagccaattatattttcgaaatcagaggtacagaagctaataaaagcagtgcatgggaaagatacccaaaaacttaaagaagcagccgaaaagaccgttgtttacggtgaacagtatccacaaggttacctgcttacttgcatcaagaacttaccggaggaagtagtaaatgaaaaatagacttaaagagttagattggagttctaagataatgaaacaaaataataaaaaagataatccctgtaaattttgtaatatcaacgacgataactatggtaaggacttttccgaagacgaatatgctgaatttaaattgtatagagtgaaggatgattattacatctataattattcagcttatagcgatcctacttctgactggtttgaaacatattctggaaagattaattattgtcctaaatgcggaaggaagttagctgaaaatgaaaattaaatcaattattgaaacaactaaatgtatgtatgcagtatcaaatgatgtagatactatttcagtttctgcagggatggaaaagtacagacaaagaatttataaaggcacaacttccaaacatttttggagaggacgatgaagatgaataacgaattacagctattcgactttgaaaacaatcaaattagagttttaaaaatcaacaatgagccatggtttgttggaaaagatttagcaaatgttcttggatattctaatactcaaaaagcgattagagatcacattgatccagacgatttaaggggtgaacgaatcgttaccccctctggaaaacaaatgacaattattactaatgaatctggaatgtacagtttaattctttctagtaaattgccaagcgcaaagaagtttaagcgttgggtaacaagcgaagtgcttccagcaattcgagaagatggagcatatattactgacaataaggctatgcaattgatgagcgatcctcaggagcttggcaatttcttgttaactattggcaatagagttaaggcattagaagctgagaaaaaagagcttaaagacaccaatgcaaaacaagcagcaaagattgctagagatgctgatgatgtggtttttgctaaggctattaggtatagccatcatgcaattcctgttggcgaattagctgaaattttaactcaaaacggttttgtgattggaagaaatcaactattccaattacttagagaagaaaaatatctttcaagttttaatcatagctggaacgtgcctatgacacagatggttaaaagagggctatttagaattactcataatttgaccagagatggcagaggatattctcaaacatgggtaacgcctaaaggtcagaaacacattattaacaaagcgttaagaggaagatttgatgatacttatcaaaaagttatggtatcaactttgaacgtttagtgaggttagaaaaatgagcgaaattgaaaacgtaaaaaacggattaacttatcttttagatattaatgatttagcaactagtgtgacagtaacagagggtggcgaatcgcatacgatgaatttaaaagatttaaaagtgacaaataccgatgttcttttacaaattgctgatttattaggtattgatatcaacaattaggaggagactagaaacgaattagaggtaggcaacgaaacaatggtcatgatgtacttaaatattttgaaatatgctaagcatcattgttctgacaacgaagatccttatgaaattactgaccgagtatttactgatgcgttagtagcaaataataaaaacaattagaagacgagagggagtgtaagtgtggttcagatgaatttagggctaatgcctgataaaaaattgactgctaagaacgtaaaaagatttttggtggttgattttcagcaatatttagacttagcgggtatgcatcgtaatcaacttaccagtcctcacctgtcattagctcctggttctactaataaaaataatattgaaaataattttattgaggatacgcaaagagacatggatattgcagatccagcaagaattgtttgtgcggctgtgtatagaactatggaggattgtactgacaccgaagataagccatacaaaagaatattaattgatacatatattaaaaaattgcgaatttttgaagttgcagctaacacttcattatctactagctctgtcgataaaaagaaaattgatgcacaggttcagtttgctaatcgttggttacattgggcagatttttatggattagaagattatcctgattttagagttatgaaaaaagtgggataaattaaaattgttacgttttttgtatgttttatttatgttcttgggaggttgtttagatgttaaattgttatcgtcgaaagattaggtggtaagatctttcgacaacacctcgacgatgctatgagtgcggtttttcgaacttaagaaatactccttttagaattaatagaagatcttgattgtgtaagtacaattgactgaccgtccttggtaggcgatagcagtcgtccgattcgactggcggttatagcctgttttcgcaggctaggtgtccctaacaaaagtatttttcatttttcttaatcctaaaaattactttttttattgagtaatctggttcgcccccagattgctcattagcctaggcaggtagtcattagtgactattatatataatagttttttcgcctaggcacaacatctccatgccatgaccctcaacggtttcgaggcgagcgtagagttaagagctggttatctgttcgcagtggaccgcaacagatgccgtgggtagaacggaacacaatttggaatgaaagaaggcgatcttctttcacgtatctagcaaggttcgactccttgcctgctcattgtccggcggaaaacggacgtaaaaatataaaaaatatacctggtaaatacagtatatttgatgttttattcgtaatagtaatatatatatacacgaaaactatattacttgtcgtttagtttacagcgtctggtttagctctgtaccttaacagagcattacaggagtgtagccaaatggtacggcatcgtgtttgagcccgagttatgttggttcgagtccagccactcctattgattagctttgtttgattatctttaatctctgttcgtttcatcaaagctaatctattggctcgttggtcaaatggtcaagacgccaccctttcacggtggagttacaagttcaattcttgtacgagctatgggaactaattgaattaattcaccgcattaagaaattcctctatattatgtatttaacacttgaggctattgctctgtgttcgctgtgcggacatgcatcccttataaggatgtccttaataaaaagaacatagtttggcaaagtggtccagtagcaacgacagcggactgtaaatccgccaccgaaaggttacgtaggtgcgagtcctacctttgccataaggacacacagcgtacgaacaatgtgtgtcctttaatttacagcatctggtttagctctgtacctaacagagcatcatggcaacttagctcagtaggtagagcgttagagtgaagttctaagtcgtcggtggttcgatcccatcagttaccataagctaagaaattatcttggctattcctaatattattcatgaagaagggtgtaaccttctttttttattgataaaattattgtgaataatattaggaggattcgtatggaaaataaagatgctataaaactagttaaatttaaagatttaaatttagaggatccttttttcgattcattgagagatgattatgaaggatttaatgattggtttgaaagaaaagcactttctgatagtgacgcttatgtgttatttaaatctgatggtatgcttcaagcttttttatatttgaagcaagaaagagatgaagatacgactatctctccaagtcttcctcagtgtaataaattaaaagttggtactttcaaggtagaagcacataaaacttctttaggtcaaagatttatgaacattattgttcaagctttaattcggtatcattttgatttaacgtatgtgactttttatccgaagcaagttcaattaaagactttgtttaaaaaatatggatttgaaaaatggggaatgaaaaataatgaagaggtttattataaggatttaaaagttaaaaatagtacatttaaagatttcccccgtattaatgaaaaaaggctagtcaataaatttttactgggaatttatccaaaatatcatactgaattatttcctgattctaaattatgcaatgaaaaagattttgttagaaaagatatttcgttttcaaactctattattaagtgctatttaggtggtatggaggaaatgagtaactttaagcctaatgatctcattgcaatatataggacaaaggataattgggctaatagtgcattctataattcagttataacatcagtttgtacagttatagatacacgtaatattaatgactttaccgatttttcgtctttcaaaagatatgtaggaaaagaaacaatattttcagaacaagaacttaaacgtttctatgaaaccaaaagatatccttatatagtaaaaatgctttataattttcctttaaataagcgtattactaatggtgaattaagaactaaattaaatattgttcttgactattggggatgtgctgaattaaacaacaatcaatttaatgcgattttaaagtatggtgaaataaatgaagattttattatcaattaagcctaagtatgtaagtagtatcatgaatggcacaaaaaaatttgaatttaggcgaaagatctttaaaagaaaagatgtagatactgtagttgtgtatgcaaccaagcctataggaaaggttgtgggagaatttgaaataaagcaagtaatttcagatactcctaagagcgtatggaatatgacagcacaatatgctggtcttgataaattagatttttataattattttgaaggattagatgaagcatttgccattcaaatttctaaagttacgccttataaaaaacaactagatttgagtgaactagaagatggaaatttaaaagctcctcagtcatttatatatttaaatggataaatatattattagcatctagtattgaaggtgattaatataaacaatattaattggacaatagtagctagcatagctgcagctgtatcagcatttgcatctttaattagcattattataagttaccattggaatagaaaaacatataaggcaaatgttgaaattgagccaaaattagaagcattatatactttaagaaaattaattccagattatattgctgaaataaattatgttacttatttatactgtaaggctgcagctaatcaaaatgatgaaagacgagctaaggagaatatacttccagacggtgtaatttggggtaatattacttttgaagatcacgatagacaaatggcaaaaaccaagctcgttcacgaacatttaacagctattcttagattagaaggggctgcattactgttaaaggatgctcaagagctttggaattgtctaagtttaaggaaagaatattataaagaagctacaaatgaattcgtatctaaaaaagaaaaagaattcaatcatttgttaaatgaaacaagtaataaattaaataatgattttatagaatattataaaagtaaaattgaactttatgaaaaaggaaagtcagcataagctggctttttattttacattaaattgaaaaaaggtggtgtggtgatatgtcatgagcaaaatagaagatgcaaaagcagattacttagcaggaatgaagtacaaagatattgctaagaaatatgaagttgcattaagtactgttaagtcatggaagactagaaataagtggcaacgtaataatgcaaccaaaaggaaaagtatgcatacaaaacaaaaaagtacgcgtacaaaacgagaaaaggttgcaccatcattaccatcaccagaattaccaaataatgatgaacttactgataagcaaagagccttttgcctgtactatttgcaacgatataatgcgacctgggcttatcaaaaagcttatggcggaaactatgaaactgcattgcgagcaggaccaagattgttgggaaatgttggagttaaaaattacttagctgagctaaagaaacaacaatcgcaagatctatatgcgaccgcaaatgacatattgctgcgctatttaaagcaggcgactagtgatgttaccgatgttctgtcttttaaaacgaaaaagcgcttggtttattacaaaattcatgataaagatggtccatacgaggatgctggaggtaagttcaggtatgagcctaagattgatccagagacaggtgaacaagcgtattactatgaacatttaattactctgaaagatagtgaagatattgatacgtcaaatattaagagtattcgaatagataagggtgagcctgtagttgaaatggaagataggcaaaaggcgatgcagattttacttgatcgcttgcctgaaccagaagttagtgatgacagtactacttccttgttacgtgctcttaaaaatggtatggataagatttggagtaaagataatgaagataactagatttaactttgttccgttttctcgtaagcaactgcaagtcttaagctggtggagtaatcctcaaattctaaaccaggaagctattatttgtgatggttcagttcgtgctggaaagactgtagtaatggcgctctcatatatattgtggtccatgactaatttttcagggcaacaatttggaatggcgggaaagacgatcggatcttttagacgcaatgtacttcgcccattaagaagtatgttagaaagcgaagggtataacgtatatgattctcgctctgagaatatgataactatcagcaaaaatgggcatacaaacttttacttcatctttggtggtaaagatgaagcatcacaggacctggttcaaggtattactttggctgggttcttttttgatgaagttgcccttatgccgcaatcatttgttaatcaagcaacagctcgttgttcagtgacaggctctaaaatgtggttcaactgtaatccgtctggcccgtttcattggtttaaactaaattggattgaccagatgaaagataagcgtgctttacgcatccacttcacgatgcatgataatccatcccttgacagtgtaactattaacagatacgagcgtatgtattcaggagtgttttatcagagatatatacaaggtctatgggtaatgtcggaaggagttatctatgataattttgataaagacacaatggtagttaatgaattacccaatcattttgaaaagtattatgtatcttgtgactacggtacattaaaccctactgcgttcctattatggggacgcaatcatggagtttggtacttggttaaggaatattactactcaggaagaactacatcccgtcaaaagacagatgaagagtattgccatgatctcaaagagtttcttggagatattcgagcagagatgattatcgatccatctgctgcttcatttagtacaactttaagacagaatggttttaaagttcgaaaggctaaaaacgatgtattagatggcattagagttactcaaactgcaatgaatgaaggaaaaataaagtttagcatgaactgtcctaatctgtttaaggaattagctagttatgtttgggatgataaagcagcagaacatggtgaagataaacctgttaaacagcatgaccatgcttgtgatgcaatgagatatttcgtatacacaattatttacaagaaagttactgcaaaagttactgtacgacctagagtacgtggcttatagaaggaaggtgtaaatgtggcagttgtaattgataaagatttacttgacgatgtgaatgaacccaatattgaagcaattaactatgcgattagagaattgcaaaatcgcaaaaaaaggttagacaaactgtctgattattataatggtaagcaagaaattgaaaagcatgagtttgataatgctaccgttgaagcagctaatgtgatggttaatcatgctaaatacattactgatatgaacgtgggctttatgactggtaaccccgtgaaatatgttgctgaaaaggggaagaatattgatgatattctagaagtttttaatcaaattgatatccataaacacgatattgaactagagaaagatctgtcggtatttgggtatggatatgagttgctttaccttaaaaaaactgatccaatatctgttagagatgaactagggaacgagaaacttactccaaatactgaattaaaaattgaagtaattgacccacgggcaactgttgtggtttgtgatgatacagttgagcatgatcctttatttgctgtatttacacaagaaaagaaggacttagagggtaatactaatggttatagcattactgtttacatgcctcagcgaattgttgaatatcgcacaaaaacaactatggaagtttcagcaaatgatccaattgtttatgatggagagaatttatttggtgcagttccaataattgaattcagaaacaacgaagaaagacagggagattttgaacagcttatctctttgattgatgcttacaacctactacaaacagaccgaatttctgacaaagaagcgtttgttgatgcattgctggttacattcggatttggcctaggggatgacaaggatgatattcaacgattaaaacgtggcgcaatcgaagctcctcctcgtgaagagggagcggatatcgaatggttaaccaagagttttgacgaaactcaagtcaacttacttagtcaatctattgaaaatgacatccacaagatttcatatgtgccaaatatgaatgatgagaagttcatgggcaatgtttctggtgaagcaatgaaatttaagttgtttggtttagaaaacttgttatcaattaaacagcgatacttttttgatggcttacgtcgaagattgaaactaatccaaactattgtaaacatcaagggtgctaatgatgatgctagtggatgtaagatctcacttgtagctaatattccttctaatttatctgatgtagttaataacgttaaaaatgcggatggaataattcctagaaaatatacttatagttggcttcctgatgttgataatcctcaagatgtcattgatgaaatgaatcaacaagatgctgaaacaattaaaaagaatcaagaagcattacgtgggcaagatccagatcgtttagaattggaggataagcaagatgattcgagtgagaatgataaagaagccggatcaaaccataatcagagccaccggacacgcgcagtatagtgttaaaggatctgatattgtttgtgcttcattttctacgcttattactcatactgtaaataattgtacgaaagtaactgcaactgataaggatggcgtattaattgctacattttcagatcctaaaagtattgaaaataagacgctattaaatgcatttgaaaatacagttaaccaattaattgaccaatacgggcaatacatttgttggtgttgatggtctatgaaagttaataagaagaaatttacgtattggcagttacgtgatttgcaagatgagcagagaaatcaagatgaagcaaccgaaaggttaaaaataattaataatgcatatcaaaaagcacaatcatatttaagcgacgaggttcaaaaaatctatcgtcgctatttttatgcagatatttcaaaagatgaagttgcaactatcatgtcatcgcacatttcgccttctgaattggttactcttaaagctttatcgtctagtatcacggacaaggaaagtaggcaagcagttgataattacttaagtagacttgcagctaagagtagaattacacgacttgaagaaatgcaacttaaagcatacattgctgcaaagtcagctggtgcaactgaattagatcaaaatgttaaattgcatactgacataatgaaacgtgcttggtcagaggcagaaaaacaaagtgctgtttatgacaccactaaggattacacattacactctcctcactctgtagaagttaaacaggataaaatagtcattaaaaatcctgatactggtaaagaagtggctactgttccgatggataaggatgttccaaagagtaaaatcactgaaatacctaatcgctatgttgaaaaatcattagaaactcgctggaaaggaaagaacttttcagcgcgtatctggggaaatactgataaattagctgaacgactgcaggaattgtttacggttaaagaactgagtaatctccctgaacgtgaaatgattaagcgaattgaacaagaatttaatgttggtaagttttatgccagtcgcttgattaggactgaagctaatttcttttattctaaaattaagctagataattggcgtaaacgtggagttaaacaataccaattgctagcagtcattgatagtcgtactagtaagatatgtagatcaataaatgggaatatttataatgttaaagatgcagtatttggtaagaatgttccaccattgcatcccttttgtcggactgttcctgtaatttatctgggtaatgctagaagtgctaataataaaccggtaaaaaagtaattcgtagacctaagcaagtcataaaactgcattgaaaactaaatatacgtatgtggatttgttactgcatatcttgaagtcaccgtgtagaaatatggggtggcttttttcatgcagttaatttgcaaatgttcatgggtagaaaggaataattatggaaaataaattttatgaaggtttattaaaacttgatttacaacgatttgctgatgaaggacaaggtgagggaggtgatgacagtaataatgcgcaagataatgtaaaagatgatagttcaacagatgaacagccttttaaaacatttagttctcaatcagaactggattcttttgtagataaaaaattagctaaggctttagatacggctcgctctaattgggaaaaagaacaaaacgataaggcacaaaaagccaaagatttaaaggaaatgtccccagaagaacgacaagaatatgatttaaagcaacgtgaaaaagctttaactgatcgtgaagccgaagtaactaagcgtgaaaataagagtaaattagccacacaattaattacagatggtttgccggcagaactagtggatgtttttgacgatgtgctagctgatgaggataagatgaccaatacttatcaaaaggttagtgatgtttttcgaaatgctgttcatgacgcagttgaaactcgactagctcaaagtgcaagacctccaaagagcttaggtgatactcaaactaaaaagtctactggagaaatgtttgctgaaagagctaatgaaactcaaaaggtaaaaaatgatttttggaattagaaaggaatagatatgtatacacaatttcaaaatggcaagcagctaaactttttagcttctgaaaagttcactgctttcccagaaacaattaataaagataattacaacgtccaaacagatgacttaggacgtaaatatgtaccagcgggaacggtatatccaactaatgatgcaaaagctgtcggaatcactgtaaatgatgtgtacgtgtcagaagatggatctaatcaaatggttgctgttatgcgtgatggttgggtgttaagtcaaagattgaatccaactccaacagcagaggctattaaggcaatgtcagcaattcactttaaagatttggatacaacgggagttgcatctgttagtaccctaaaggactaatagaagggagaatataattaatgaaaaatcaaaaactacaattagatttacaacgatttgcaacacctattcttgatatgtttagtcaaaatacggtgcttgactatacccgcaatcgtcaatatccagaaatgttaggtgatactttattcccagcggtcaaagtaccaacacttgaagttgatattttgaaagctggtagtcgtgtaccaacaatcgcaagtgtttcagcttttgatgctgaagctgaaattggcactcgtgaagcaagtaagatgactgctgaattggcatacgtgaagcgcaaaatgcaaattactgaagaaatgctaatcaaattgcaatcaccacgtaatactgcagaagaaaactacttaaaacagtatgtttttgatgatattgacgctatggttcaagcagttaaggcacgtggcgaaaaaatgactatggaaatgtttgctactggtaaaattactgataagaaaaatggcattgctattgattatggcgtgccaaagaaacatcaagagacattatcaggtaccaagacgtgggataagagtgatgcttctattattgataacttgcaagattggtcagattcactagatgttacaccaacccgagctttaacttctaagaaagttttacgtatattaatgcgtagtactgaaattaaagaagctatctttggtaaagatactggacgtgttgttggccaagctgatttagatcaatggatgacagcccaagggttaccaattattcgtgcttatgatggtaagtatcgagatgaagattcaaggggcaatttaacaactaactcttacttcccagaggatcgcatcgttcttttcaatgatgaagtacctggacaaaagatctatggtccaactccagaagaaaatcgcttaatttcaagcaatgctcaagtatctaatgttggcaatattatggccaagatttatgaaactagtgaagatccaattggaacatggattttagcgtccgcaaccatgcttccatcatttgctagtgcggatgatgttttccaagctaaggttctttaattaagggaggtgcttaatgtggatcaactaacggaaatagtttcagctttaagtactcgattagaaaatgttaataatgccttactaactgaactagttaaagaatcgatagcacaggtactagattacactggtcaaaagaaattagttggtagtatggatatttacgttaaaaaactagcagttattaattacaatcggttaggcattgaaggcgaaacacaacgttccgaaggcggtataactaactatcttgagactggcattccaaaagatattcgacaaggattaaatagttatcgaattgctaaggtgaaaaagctatgagattaaaagacagtgatcttataactgtttatcttagagaaccaatgaatactcaagatgatgaaggttatagtatttgtggctggggtgatccacaaccaattagaatgaatgttcaatcagctggtggtacggtcaatgctcaactttatgggaaagatatcaagtacatcaaaacatgtaagtatcaaggtgatttacttgcagagggacatggtgaaggttttggcgtttgtctaaaggtttccagttctagtgatcctgattacaagattacggctattcaggagttttctactcataaaaacgttactttagaacgtataaagagggatgaacaaaatgattgaagttgaacttaaaggagtcaatgaattaagagcaaagctaaagaaattaccggatataatggcaaaagcaacagctaatgctcaagaaaatgcaattgagcaggcggaagcctatgcagttgatgagttgcaatccagtattaaatactccaccggcgaacttactcgaagctttaaacatgaagtgaaggttgatggagatgaagttattggtcgttggtggaactcttctatggttgctgtatttcgtgaatttgggactgggttagttggtgaacggtcacataagcaacttcctaagaatgttgctattatttatagacagacgccatggttcttcccagttgattcagttgatcttgatctcacaaaaatatatggcattcctaagattaagatcaatggaaaatatttttatagaactactggacagccagcaaggcaatttatgactcctgctgctaataaaatggctaaggaagcaccagagattataaaaagatcaattgaccaagaacttcatgataaattgggtggttaaatggaaatctataatgttaaagcactagtgtttaagactttaaagtctatgccggaattaaaactagtttcaccatcttatccagataaatttacaacattcccagcagctatttattcaactagtcaatcttcttatatacgtaatgcacaacaagaagagacagacactgaatggaagataacaattgatttatataatgaccatggatcattaactaatataaaagcaaagctcattgctagattttcagcaatgggcttttctaatagtgttggtgaccaagatttaaatggagtatcacgtgtggtaatagttttcgcaggaattgtagataatactagccatcgtgtatatcagaaaggataaaaatgaacaacgtaaaattttatagtgatttattaacattagaccttcaacgttttgcagttgatagctcagaaggtcttgcaggaacaggaacaacactcgaaagatcagtagatggatcatcttgggatgaaattgctgatattaaaaccatccctgaattgggtggagacactgaaaaaatcgatgtaactactttggcagatgatagacgtaagcaaattgaaggtattcaaaatgcttctaacgttcaattccaagcagtatataagggtgctagttttgcaaaagctctggcgcaggctggtgatagaaagcaataccaatggaaagttacatatccagatggaatgacagctacgatgaaaggatcatacaacattaaatttggcgcagtatcagttaacggcgcattaggttacacaatcactattactgtatctgatggacctacatttgctgctgcaggagcagctcattaaattggtaagtaatagaaagtgataggcgtgggttcgattcctacgtctatttttatacaacatgaataggagaaattatggcaacaacaattaagaaagcaactaaaacagtacagctaggtgatcttgaacttaatttaaaactaggtggccgtgagatttttaaaattgaacgtcgtctaggtaaatcaatgctttcactttttatggattcacaaggcggaaataaattacctcctgtaaatgaaattcttatcgtattacaaggagctaatcaaaatcacggtgtaacagataaacgagttattgaagcctttgaaaagtatttagacgatggtcataccactatggatttgttcaatgaattaatggaattatttgatgaatctggttttttcggcaagaaaaagaagaaggctacaaagaccaatatggaatcggacgaagtaactctagatccagtggaagcagaaagcgaattgatgtagatgcaaatcatttcgagacagtatctgatctatttagacatctgtatccaatcgcagtggaatcaggtatagaggctgaccatttttgggatatggatttcggtgaaattatgacccaaatttcagcaaatgaaaaacgtcgattggaagatttacgagctaaagcttatatggatcatcgcctaagtgaaatgatggcttttgcttttaacgatccagcaaaaatgcccaaagttgaagaagcttatccatttgtgaaagataatttggatcaaacaaatgagaggtctgaggaagaacccaattggaaaaaagatcagattatttttatgcagcaagcccagaaaatcaaacaatttaataaagataaaggaggtggaaattaatggatctagaagaacttgagttaagatttagagcaaattatggggatgtcattcaaaagattgatgaattaactaatcttattgtgcaaaaaacaggtgatatgcaatataagatgcaaaataatttagataaatttcagcaatcaatgaatgagagtacttcaagagctaatgaaaatgttaaagaagagattcatcaacgtagtgaagcggaagaagctaaacaaaaattacttgagcagactcttaatactcaaaatgaggtaacagataagattgttcaaggaaataaagaacaagccgaaagctctaaagaagctgttaatcagtcagaaaagagcctggatagtttaacagctcgcttgcaagaagcttctaatatgcaacaacgaattgcacaacaaactagtacagctcatgatgtaataaaagatatttctagacccaaatcacaaacgcaagtaaaagaaccattaaagtccacttcacagaatgactactcaagctttgataactatcaagaaaaacgaattcagagttatatgccaaagcgtcctgttgatttaggtattgatgatgaaatacaagctgaagcatccagagctaaaaaagaagttgatagcttagtaactcacatcaacgagaagatggaacaggctcgatcaatgcaacggagaattgctactttaacagctaatcgagacaatctggatatgagcaagcagggtagtaaagttaaagcaatgagattagatgatcaaattgctgacgctcaaattaagatggaacggtatcagactcaagctaaggctcttgcacaggaaatgtcgcaggagcttgatactgttcctaactcattaagacgcattgagcgtgaaatggatcaaacggaaggcaagattgaacgaattagacgttctattgctgaaatgagggataatgatgcgactcttggccgatcctcgggcactaataaagagattaagaatgctgaagctgagtacagaagattagttgctagaagtaatgagttagcaaaggcatatacatacgtcagtgcacgtggagatgagttaagaaatagttcttcacgaattaatactgaattagctgaagaaaacagaaatgtctcaaatcttggttctaagtttagcaggctaaaaaatactatttctaatgttaattcatctcttagacgatttggtaatagtgggaattcttctatacggaaagctggatcaggcgtttcagttttaagtgaacgactaaggggcgttcgaatggcaattcgaatgttagccagtcaattaattgtgtttactctgctctatcaaggaattatgatgcttgcccaaggtatgggtgcagcattaatgactaatcgacaatttgcaagtagttttaacgcaattaaggttaacttgttgactgctttttatccaatttatagttatgttttacctgctataaatgcttttatgagttcattgcaaaaagcaactgcatggattgctcaatttacttctgcgttaacaggaatgagcttgtctagtgctagaagtggtgctcatggtttgtacgatcaagtacaggcaatgaatgatacttcaaaggctgcaagtaaagctaatgaagctgttaaaaaacaacagcaagaacaagctaaagcagttcaacgtgctaatcagcaaattgctcaagctaatcgtcaaggagcggcagccgttgcagcagaaaatgaaagaataaaagcatctaacgaacaagctaaaaaagcttttgaagatacaaagaaagctaatgaagaccttcaagcatcactcatgggctttgatgagctgaacgttttagataacagcaaaaacaataacgataatggtagttttgaagctcaaccactagaaaaatttactccacagcaaaagcaggatacacctatttttgatgatcccggaatagatgatggtgagacaggtggaaatcaggggcttgattggaatgttccattagttgcatcccaaaatgctattgatgctgctaataaagttaaaaaggttttaggcgaaatctttgatccaatgaaaaaagcttgggatgaaaaaggccaagctgttgttgatgcagctaagtattcatggactgaaattaggcgcttattaggggatgtaggtaattctttcttacatgtttgggacaatggaacaggacaaaaagtaatagaaaatctacttcaacttttagccgatatgctgaacgtcattggcgacatttcacgagcttttgcagaagcatgggaagagagtggtcgagggaccaagtttattcagactatcttcaattctctcaataatgttcttgaaactatccatcatatagctcaagcgtttcgtgatgcatggaatactggtgatctaggcaagagaatttttgctaatttgcttgatttagctactaagttagttgggtttgttggcgatattgctaaatcctttgatgaggcatggcaacatggtaatgccggaactagactatggcaagcttggctaaatgcactgaataatatacttgatacttacaagcatatagttacatcaattgatgaagcatggaaacactccaacttaggcgtttcaatttggagtcatattattcaaatagtaactggtgtgggaaacactattggcaatttagctggtcaatttgataaagcgtggcaacatggaaatgttggaacttctatctttaaaactttgctcggtatggtagatgacatgcttggatcacttggtgatatggcaacgtatactgcaaactgggctaagaagcttgattttaccccattgcttcagtcaattgataatctgctaaaagctattcgaccagtaaccaaagatgtttgggatggattatcgtgggcatacaagaatgtcttgcttccactcgcacgttttacaattactaaggtaatccctgagttcttaaatgccttagctgctgctcttaaagtcgtacatagtgtaatcaaagcggcagaacccgttctagaatggttcttcgatagttttattaaaccattggctaaaatagctggttttgcaattgtagaggctttaaaacttctaactaaagcacttgagggcttatctgattggatagatcatcatcaaacggccgttaagatcatgactgcaacgttgcttacgcttttaggtattaaggttgctaaagctactattgctggaattcaaagctttactgatactctgaagatccttgcaatgctcaaatttgataaattgaaagctgctgcaaagtatgctgatgatttattaggagtagcaattgaatttgcaaagcacccaataactaatattaaagaacttgcaaaattaagttttgaaaatatcaagggtggctataaccgcatcaaagatctttggggtgaagtaaataaaggctggcaggatagtaatcttgccaagaccgattttcttaaatctgctcgctcttcaatacaatctggcgaaccaatgaagctggggcaaaaacttggtactggcttatctggtgctatgattgctgtaacttcaggaattgatatctacaaaggaatcaaagctaataacaaagaagaaaaatttgcagattttggttctggaattggtggtgcagttggtggtgccattggactctggttcggtggcccactaggggcagccgtaggacaacagattggctcattaattggtaaatggggcggtgttggtgcctctaaatttggtgatggttggtctaagtatggtaaaggtaagaaacctaaagactgggttgaagccataggctttaaggcccatgaaatcttagataactttacttcttgggctaaatccgttggtagagatattaataacaatatttctaaaggtaaaaaagatgttcaaactgctagctctaatatccataaatggtccactaattttatttctggtgcaaagaaagatattaaatcttgggcacaaaatatcggttctaacattcataaagatgtagacaaaggtaagaaactagctaaacaagctggagataaagtaaaagaatggtctactagctttattagtgatgctaaaaagaaagttcatgattggtcttctcaaattggttctaatgtaaataatagcgttgaaaatggtcaagccatggctaagaatgctggaactaaaattaaaaattggactaccgactttagagaatcagccagtggactagtaagatcatgggccgaaagactaggagaacacattaataatggctctgaatcatctcgctctggagccactaatgccggtaataaaatttctcaatggacaagaagtttctttggaggagccaaccaaagtgtttctagttgggccagtggtctaggcggtcatgttaatgacggaataggtggagcttataactctgctaaaaatgctggtgaacgtctaggaagctgggtttcaagctttagacatgatacttcaagaaaacttggttcatgggctggcactcttgggagcacaattgggaatggaattactgatggactgcacaacattagtcgagccgttcgaaaagtggttaatgcaattgttaaaccggtgcaaaatgctactgatcaagttagaaaaggtattaactgggtacttggtaaacttggtggtgggtcaattggctggggattctttgattggaattcttatgcgaatgggacgaatagccacccaggtggactagccttggttaatgatcaagccggagacacttatcgggaaagttatgaattacctaacggagaacaaggtttattcccagctgaacgtaatttgttaacttacttgccagctggcacaaaagttaaaactgcaactgatacggctaatgaattagcaggtatggttcctaaatatgctggtggtataggtaactttaatttcgattttagtggtatctttagcggaattagtagcgctcttggaaacctaaattttgggaatatatttgatggggttggcaattttgttgatggtgtaatggaagaacttgaaaaagttactgatgatatagctcatccagaacgattagttaactacattattgataaatttgtcacctatgattggagtttaggcgacgcttcattaaagtttgctaaaggcgctgttcatcaagaaaagaaaggcatgatgaattgggctaagaaagttatcaatcaatttggtggtgcaactcatcaaacagggctgggtgcggaaggttggcgtagtgctgttaagaaagcattgcgcaagaatggtctacctgcaacaccagcatatgtaaatgcatgggttcgtcaaatccaaactgagtctggtggtaatgaacatgctgtacaaggcggttatacggatatcaacaccttaacaggagacttggcaaaaggattgttgcaaactatctctgcaacttttaacgcttataaattccctggtcacggtaatatctttaatggttacgacaacatgcttgcagcaattaactatgctaagcatcgctacggttcagacatgcttgctgttatcggtcacggacatggctatgaagacggtggcttaattgctaaacacggtttctatgagattagcgaaaacgacaagccagaaatggttgttcctttaactaatcgtgagttaggtatgcgaagaattaatgaagctattgcatttatgaatcagaattttggtggtggcttgcaaatgccatcttccttaagcagacgaactgctattgatagttcaatttattctgatactcaatctaatgactctacgtcagttcagcgtggaggattcaaagagatgagtacagaattagtaaatgctatagttcaagcaattcaaatgcaaaactttaatagtaataacggaaaacctattgatttacacttatctgtcaagattggtgatgagtcatttggcgaacacgctattaaaggtattaatactatcaatcaaaagaatggtagaaacatgttaaatctttagaaggaggaaatgagtgattgtattctttaaaaatttctgggacagtggttaatcctgccccgcaaactatgcaggtaacaattcaagatattgacgcaaaagcaacgcgtgatgcgcaaggattattgcaccgagatcgagtagctactaaaagaaaaattacattggcatttggtgcactcacggttccggaatgtgcaaagattttaggagcagttaaaagtgaattttttatagtagattacttagatccacaagatggaaatatgcggtcaggaacattctatgtgggagatcgaacaacacctgtttattcctttgtagattcggtccctgtttggaaaggcttatcctttgatttgatagaacagtaggaggtgagaaatattgctaacacaaacgaaagaagttagggatgcttggcgagcatcacaacgaacgttagatattaaagtggcagttaatgggaaaacttataccgctaccgatatcaacagtttgaaatatgattcaggagcttatactggtgacacgtttgccattggctcaacatactcaaatagtgttcaaattgaattttcacatttaatagagaatctaaaacttggtatggaagttttaccaagtatcgggattaagacgtctagtggctatgtatatgagccgttgggcgtttttattatctctagtgaaatcaagatggatcgcaataacaatcttacttccattagtgcaagtgatagattttgcgggttagaaggatcctataaatctaagctggcttatccagcaaaagttttagatgtaattgctgaaatctgtgaacaatcaggagtcaaggctaatgtggatgatctggctagacttccacatcaagctgacttacctagacctatcactggtcaaacatatagaaaggctttaggttggattgcacaactatatgccgggtatgctacgttcgatcgtaaaggtttatttacgattagaactatcgcagagcctaattatgagttagatcccagtcagtatgaacaagctggtttaactaaaaatgaagctccatatagaattagcggtattcagtgtcaaacgacaattaccactaaaactagggatggtgaagatactgatgaaactaagaattatcaagttggagatacgaatggatctcaaattaagcttgaaaacaatattatgacgcctgataggctgactaatatttgggagcagattaaagatgttaatttctatccatttagtttgaattggtttggaaatcctgcaattgaagcgggagattggttaaaactacaagacaagcaaggcaataagtttattgttcccaacaatagctacacacttgattttaatggaggactttcagcaacttctaaggcagatcaaacttcttccacagactctgtaatagcttgggagggaactttctctcaaactattagagaacttcaaggtcgtaaagcaccagatggaacagtgatttttccgcctagtgtaactgaaccacctacgaatgctaaacctaacgatgtttggttcaagcaaaatggtaattcaacagaattgtgggtgtttactgaacaagaagatgggactagaaaatggattaggagggatttaactcctgacgagattaagaaacaagttcaagaagcacaagatggcttgaaagatgctaagaaagaaatagcagataatcttgctaaagcggataaagatattgctgaacttaatgaaagtattaacaatcaaaaaggttcacttgatggtctaagtactacagtcaataccgttgttattcctaaagtaaccgatgtaactaaccaagtttctgatgctattaaaaaagtaaatgaacagaaaaatattgttactggactgcaaaatcaggctattcaacaaggaaaagatatctctaagattacttctgatgttcatggtgtaactgttgatctagctaatctcaatggggatgtaaaccagacaaaagccacagttcaaggccttcaatcaacgttaggcaatgcccaaggtgatattgcccagatcaaagtagatgcgaagaaattggaaactagtctatctggtaaagttgataattctacttatgcaacttttgttaatcaaactaatcaagcattaaatgctaagttgattgctagtgatctgaatggatatgctaaaactactgatttgcaagctacggctaatggattgcagtttaatatcaatagcgtaacggataaattgaataatctaagaattggaggtagaaatttagttggtgggactgacaaagaatacgtaatgggatttggaattcctaataccgtttggaaagataattttgcttatatctctttaccgttaattagtggtgatggaggcgaaattttaccccaaggtgcaggattttggcatgtattaagtccaggagaagaatatactcaaaccatttggatcgaaacagatgctatcataaaaagtttaaatggtacatttttaacatggctaactatggacgatgggcatgatgtgcaaaaagcatatattcaaaggataggcaataacagctataaaattgtaggttcttatacttggccacaaaataaaaaaggcaatagagttcgcttatttgatatttttagtttgccaaattcgattgacttgaaaagtggaacatatctaaagtttggaaaactaaagttagaagtgggaaatgcttcaactgactggactccggctgttgaagatactgaacacgatctagaaagtttgtctgcacgcataactattaatagtcaacaatttggttcttactatactaaaggtgagtctgacaatagaactaatactgcaaaaaatgaagttatcaattcaattaagaatgatagtaattggcatggattaaccaatatactaacgaatagtggctttatacaaaccgcagatggctttatacaaaaagtacagcaaacgatgcaaccaattattaatgaaaataatagtggtggagtgaatttattaactaatacatatactttgcgtaactttaataatgccggtaatgctggagaagctactggatttgaaattgattctggagatagccataaaaacgaattaaatgctggtgaaataagcacaaatgtttttcatgtttatgccaaagatttaaatcatgctcctgtttactttggtcaaaactttacactacccaaaggaacttggactctaagttttttagttcgtcataatggaagtagtgaacaaaaaatcagactaagcttttatacagacgattgtgctaacagaggatggattcctctaggaacatctgatgagatagataacatttggaaaagacatcagataacttttacaacaacccaggaaatttttgaacaaaatccgagagtacatatgccaactgatgatatagtccccggtggctctttgtattttgcaaattttaaattagaatccggatcaattgctactacttggtgtcctgctcccgaagatttagctaagcaagtagcagttactgaattaggtcaaaccataaaagggcttcaatcaactgtttcaagtaactacggaaatctacagagccagataagtcaaactgctggaactattaggaatgaaataactgatagaaccaataatctacaaagtcaaattactcaaaatgctaataatattagtattaaagtaaatgccgtgggggatttatctaacatatgtttaaatccaacatttattgatggaagtactgaaggttgggaaaacgtatttagttcgtctggagatcccggtagtcctacaaagttttacgggggagttaatacaagaaatgcgttttacggaaatatgttctcagtggcggcaggggataaatattttttctcggtctttgcttggcaaaatcaatctactaatcctttaaatataggatttacttatttgcaaaaagatggaacttggaattggcaatccgctataaattttgctcctaatgaaggtgcgcgaactaaatcaggatctatcactattcctaaggaagcagttaaagccagaatatgggtagaaattgattcattttctaattttggaaattggtggtttaccaatcttatagttagaaagaatgatactatctcgcaaattaatatgtcagctggcacaactttaatccagaatgacaaaatatatatggatgcaagctcaaccgtattttctggtaaagccttcattcctgatgcagcaataactaatatatcagctgataaaattaacactggtacactcgatgccggcagaattaatgtaattaacttaaatgcaaacaacatcactactgggacaattaagggacaaaatagtagttttaatttaactgatggaacgttaacggctttaaatcagtataatgagggcgtttttatgagaaatgggaaacttgagtttacctcacgtcaaagctggaataataactccacagctacatatggatatattcaatctttacccaaaatgtttgccttaggatataactatggtggattagatattaatggtactagtgggtttgtactgcataatgataaaacgaaaattaagactagtaatagtggacagagtggttcagcagttgaaggaggaagctatatttttggatctgatggtcttactagcataaataatgaaaattcagtgattattaatgcaggtgctcaatcatacagtgagtggacggctggaataagcttattatcagggaatgcatctagaaatgttcctccaagtatcactttaggatcctctaacagtctcaatgatcgctctacagttactatatctggaagtcttgcggtattaggatcgaagaatgccgctgttcgaacatctcaaggattaagagctattaacgcatatgaaacagccgaatattactttggagatataggaagggcaaagactaacagtaatggggctgtttgcatatacatggatccgttatttcttgaaacagtcaatacaggagttccatatcatatatttcttactagttatagtgaggcaagaatttgggtttcagagatgtatccatcatattttgtaattagatcagataagccaaatgctgactttgtttgggaaattaaagcaaagcgtaaaggatatgaaaatgatagattaaaaattatagatcaggagaaaaaagtaaatgaataacaataatgcagtatcacaaaaattaattaataaactagcggttagtgagtataacaatgcagttttagaagcaaaagttgatgagctaaatcaagaagtaaatcaattaaaggcagaaaaggagaataaagatgttaaaaacaagtaaatcaatcgcaatttcaggtcgttcaatggtagatgataagcaagtagcaacttttaacgctaatatttatgaagctaatgcttcaggtggtagtgacaacattaatatgattattactgatcgggatttatatgatgcaaacaaagttactgtacggaaggatttacaagactttcaaacaaaagtatggtcagcacaagatgaagtgatggcaggaagtgatgaaaaggcaagtgaaggttaatgaatgagatagcaaaactatgggaaaatataaaacaaaatcctctgcatttaattattgggctaatgatttttttatcaggaagctttttgttactttgtgatgatttctttctttggccgcctgaatggaccaatgtttttaataatgatctgattgacgctattgcgattgtgataggcgtcttttattttgcttacgttttagcaggtgctaatagtccactagctaacatttgtttattaacggctagtgctttccttttaacaattctcattgttttagaaattgggtgcgttttagcatttcaaaattatccattagtaatggcagcaatttatcagttcggtgcattgctattagttcaagtatgtgcatcaagatcaccaggcttaaaaagaaagtagggataagaggtgcaagaatggattgactttgtacaaaaaattgcatttcttatttctagcattgtaggacttttaacaattttcaatactcttaagcaaacagactattcaaatgctaaggaaaagaaggaagagctaaaggaagatgtagagctttatagaaaaagatggcttcaggcagaagaagcctacgataaacttttgaaagacaatgaaaggcttaaaagacaagttactagattagaaagtaggaaaaataatgaataatattttagttaatgtatccgctgtaattgttgcattggtattgtcatactttgtattttggtatcgaaatcataaaattgaaattgataaaaaaagagctaagggagatgctttagcttttgtggttgatactttgggtcaagttgctaccaatgtagtttacgatttaaaggataattcagaaaaaggtactgaaaagaaagaacaagctaaagttaaaattaagaatttttatgctgacgcacatttaccagcacctagtgatgcccaagtttctggtgcaattgaaaaggctgtagctataatgaagatgtcaagcgaaggtgaaaagaatgactaaagtagaaaaaagaagttatggagtagatatatccagctttcaggggactgatttattagctatgggcagatcaggtgctaagtttgctattgtaaagacttctgaaggactggactatagaaatccaaaagcccaagctcaaattaatagcgctagaaacaatggaatgatggttagtggatatcactatgcaagatttagcaataatgctaatgtagcagctcaagaaggaaactatgcagttagttcagctaaacaagttggcattgaaccaggtagttacctagcttgtgattatgagcaaggcagtggaaatgaaactggaggtaatcgtgaagaaaacacgactgcgattctagcatttctaaatacaatcgttagtgcaggatataagcctttattatattcaggtgcagaacttatgaaaaataaggttaataccgctaaaattttggcaaaatatcctaattgcttatgggttgccgcatatccttataaaggagcaacaaatactgctgatttcaattatttcccttctatggaaggcgtgatcatttggcagtttacagataattggcgtggtatgaatgttgatggaaacatcaacttattagaattagaaactaaaaaatctgtgtcacaaccagctaacgcacctggagaatctactagttggattgataattttggagataaatgggttaaagaggatggcacttttatcactgatcgaccaattaatttgagaaaaggagccaagctcactagtgacattatcactaccttaccagctggttcagtaattaaatatgatgcttatagtagacatggtggttatgtctggattagacagccccgtgaaaatggccaatacggttacttagtttgtcgtcaaggaaataccccgtggggaacatttaaataaagaaaaaagccactctggagaaattaattctctggagtggcttttttgcatacaacaaattttctattattttaactatgttttcttattacaattttacttacaaaatgttatacttaacttgcaacaagttagaaattctaaaattcaatgcactcaaaaagcattacctgatcgtcacaaaaggtaatgcttttttatcgcttagtgcaaccttctaagcgttgagggtggagtaaggcgactattaatgctttttgttgtgatgccgatcatccaaccagtgatcgaatagtgatttcactatttccacaagaatgggagctacaactaaagttagaaattccttcaatgaactcacctcctttcaagaggaggcaatagtcgctgaaataattatagcaaaatcaaagtcggaaaagtgattgaaaaaagcaagtaaattagctgaactttttaaagattttggttatgaagcttactggaaagaaaaacacgaacttgactttagagacgaggatctattagcagtaatcgatttaaaagacgttagtcaactaaaagagttagctcttgaaggtaaaatttacgtagactttgaaaatcaaataattgtacccactagctatgaagtagatgactaaaaatataagaggttgttttagaaaattaatttcctaggatgttttgtttgtggtaacaaatggtaacaattttggtaacatagcattgaatagttatatcaacataaagcaatgaagtttgatagatcaataattcaagtggctaatgtaaacataaataatcaagcactgaaacctgtcatcccgattgaatattattttgttaaaaagttcgtcttgggttagaaagacgaacttttttgtatataatgttcatgaaatatcaaaaagtttacatttactaattgtaagtgataagatatttgtctaaagattgtaatattgatcttaaaagaagtaaggcggtgcaaaatggaaaaatcatatagtgatagtgcaaaaaatgttcttgaaattgctaaagagcaagcacaaaactttcaccatcgaattattggaacagagcatgttctgcttgctttagtaattgaagctaatggggatgctggaaaacttttgcgtgaaagaaatgtaacactaaccttagtgcgagaagaaattgaaagatatactggctatggttcaagtccaaaggccacatatatggaaatgtccccacgtttaagtttagttttgaattttgctaaacaaagggctgacgaattagggactgctcaaattgagacaaaacatattttgctaggtttgttagctagtgatcaaattttagcaagtttaattttgaaaaatattggtgtagatccacgagatttaagtcaggatgtaaatgatagtttcatggatggttctggggaagaaaataatgttcttggtatttcttcagccactggtatgaaaaaaggtaagtcattgactccaaatttagataaagttagtgtgaatctaaataaaagagcccgtgaaggtgcaattgacccggtaattgggagagataaagaaataaaaagagtaattcaaatcttatctcgaagaaccaaaaacaatcccgttttggtaggagaacctggtgttggtaagactgcagttgcccaaggaatagcagccgcaattgtaaatcatgaagttccagatactctagctaaaaaacgagttatggccttggacatgggaagtttaattgctggaactaaatatcgtggtgaatttgaagatagaatgaagaagattctaaaagaaattcaacaggatggttcagttatcttatttgttgatgaaatgcatactttgattggtgcaggtggcgcggaaggtgcaattgatgcttcaaatatcttaaagccttcattagcacgtggcgatattcaaatgattggcgctactacttttgatgagtaccaaaaatatattgaaaaagatcaagctttagcaagacgttttcaacaagtaaaaattggtgaaccttcaaaagaagaaactgtggatattttaaaaggcttgcgccctaaatatgaaaaatttcacaatgtaaaaattgaagatgaggcaattaatgatgcagttgaattttcaacacggtatattgctaaccgattcttacctgataaagcaattgatttgattgatgaagcaagcgcagctgtaaaaattcaagcaatcggtaaaagtgatcctcgtctaactaaattggatacacaaattaatgatgttattcatcagaaagaacaagctgcagaaaatcaaaattttgttcaagcagctaagttacgggatgaggaaaataagcttacacaggatcgggataaattaatcgaaaaagtagagaataaaaactctaaaaagtcgattgttgattctgataagatcgctcaaattgtatctgaatggactggtgtgcccgttactagaatgaagaagagtgaaactaaacgtttagctcatttagaaagtattttgcatgaacgtgtaattggacaggacgaagctatcagtgccgtaagtcgagcaattagacgaagtagaagtggaatcaaggatgaaaatcgtccaatcggttcgttcttattcctaggacctactggtgttggtaagacagaattagctaaggctcttgctgcagcagtttttggctcagaacgaaatattattcgtgtagacatgtctgaatacatggatcagattgcaacaagcaaattaattggttcggcaccaggatatgtaggatatgaagagggtggtcagctctcagaacgtgtaagacgtaatccatattcagtaattttattggatgaagtagaaaaagctcatccggacgtgtttaatttattgcttcaagttttggatgaaggatttttaactgattctaaaggtagaaaagtcgattttagaaataccattattatcatgacttctaaccttgggtcacgtagtttgcaagaagataagacagttgggtttgcagcggataatgctgataaaaataaacttcaacaagaaaaagttacggcggctgttaaacaattcttcagaccagaatttttaaacagaattgatgagaccgtggtctttgatagcttaactaagaaacaattgcgtgaaattgttagcttaatgactggtcatttggtagatcgcttagctaaaaaagacgtaaccttaaagatttcaccagcggctttagatgtattggctaaagatggatttgatccagagatgggcgctcgtccattacgtcgtgcaattcaacatgaacttgaagatgtaattgctgaagatttaattagtgaaaaaattaaggctgaccaaattgtaaaagttggagctcatcaaggtaaattaaaatttacaattcttgataaagataacactttagtgaaaaattagttttttgacaaattagtaatataagtgtaaaatactaaacgtttaaaaggctgaaattcaggatttcgctgatctattgtccagcgagatgataaaacaaaaacgacatttacgttgtttttgtttttttgtacccaaattttgactttttgcaatttgtaacacaaatgtaatatttagattcttatataagaaaggatgttttctttgttaggacacgctgtgaactacggtagtcaccggacaagacgtagcttctctcgaattaaagaagtattgaagttacctaacttgactgatgtacaaacgcaatcttacaagtggtttcttaatgaaggtattcgtgaaatgtttgacgacattatgccgatttcagacttttcaggaaaactttctttagagtttgttgattacaagctcttgaagccaaaatacactcttgaagaagcacgtgatcacgatgctaattactctgctcctcttcatgtaactttgaagttaaccaaccatgagaccggagaaattaagactcaagacgtcttctttggagaattcccattaatgactgattcaggaactttcgttattaatggtgctgagagagttattgtttctcagcttgttagatctcctggtgtttactaccattcagattttgataaaaatggtcgccaaattttcggtgctacagttattcctaaccgtggtgcatggcttgaatatgaaactgatgctaaagatttagcttatgttcgtatcgatcgtactcgtaagcttcctttaactgttttaattcgtgctttaggatttggttctgatagtgaaattgcggatatgtttggtgaaagtgattcaattcgtttcactttagaaaaagatatccacaagaatcctgctgattctcgcgttgcagaagcattaaaggatatttacgaaagattacgtccaggtgaacctaagacaactgattcatctcgttcacttttatatgctagattctttgatccaagaagatatgatttagctccagttggtcgttataagatcaataagaaactttctttaaagaatcgtttactaagacaaactttggctgaaactttagctgatcctgatactggtgaaatcattgctaaaaagggtgacgttgttacccacgaacttcttgataaattatcaccttacttagatcgtgatgactttaagatggtaacttatgaaccttcaaaggaaggtgtgttacctgatccagtaacagttcaagaaattaaggtatattctaaagttgatcctgaacgtgtagttaagttaatgtctaacggccacattgcagatgatgttaaacatttaactcctgctgatgtattggcatcaattaactacttcttcgaccttcaagataatattggtactactgatgatattgaccacttaggtaaccgtcgtattcgtcgtgtaggtgaattacttcaaaaccaatttagaattggtttagcaagaatggaacgtgttgtacgtgaaagaatgtcaatccaagacatttctactgttacaccacaacaattaatcaatattcgtcctgttgttgcttcagttaaggaattctttggttcatcacaattatcacaatttatggatcaaaacaacccacttggtgagttaactcacaagcgtcgtatgtcagccttaggacctggtggtttgtctcgtgaccgtgctggatatgaagttcgtgacgtgcactatactcactatggtcgtctatgtcctattgaaactcctgaaggacctaacattggtttgattaactctttagcaacttacgctattgttaacaagtatggtttcattgaaacaccatatcgtcgtgtttcttgggatactcacaaggttactgataagatcgactacttaactgctgatgtagaagataattacattattgctggtgctaacgctcgcttaaatgaagatggttctttcaaagataagattgttttagcccgtcataaggaagataacctagaagttacccctgataagattgactacatggacgttattcctaagcaagtagtttcagtaacttctgcatgtattcctttccttgaaaacgacgactctaaccgtgctttgatgggggctaaccaccaacgtcaagctgttccattgattaatccacatgcaccaattgttggtactggtatggaataccgtgcagcacatgactctggggatgcattagttgctaaagctcctggtgtggttgaatatgttgatgcaaacgaaattagaattagaagagacgatgatactttagataagtatgttcttgaaaaattccgtcgttcaaacgcaactaagaactacaaccaaactccagctgttaagcaaggtgaacgagtagttgcagatgaagttattgctgatggtccagcaatggaaaacggcgaattagctctaggtcaaaacccaatcattgcattcttgacttggaacatgtacaactatgaagatgccgttatgatttctgaacgtatggttaaagatgatgtctacacttctatccatattgaagattatgaatcagaagctcgtgatactaagttaggacctgaagaaatcacacgtgaaattccaaatgttggtgaagatgcacttaaagaccttgatgaagaaggtattgttcgcataggtgctgaagttcaagatggtgatatcttagttggtaaagtaacccctaagggtgtgactgaattatcagctgaagaacgtttgcttcacgctatttttggtgaaaaagctcgtgaagttcgtgatacttccttgcgtgtacctcacggtggtggcggtattgttcaaaacgttcaagtattcactcgtgaagcaggcgacgaattgccacctggtgtaaataagatggttcgtgtttacatcgttcaaaaacgtaagattcaagtcggtgacaagatgtctggtcgtcacggaaacaagggtactattgccttagtttgtcctgaagaagatatgccatacttaccagatggtcgtccagtagatatttgtttgaacccaatgggtgtgccttcacgtatgaacattggacaggttcttgaattacacttgggtattgctgctaaacagcttggtattcacgttgctactccagtatttgatggtgcttctgaagatgatatgtggaatatggttcgtgaagctggtattggaaaagatggtaaaactgttctttacgatggacgtactggtgaaccgttccacaaccgtgtttcagtaggtattatgtactacttgaagttgactcacatggttgatgataagatccacgcacgttcaattgggccttactcacttgttactcaacaaccacttggtggtaaagcacaatttggtggtcagcgtttcggtgaaatggaagtttgggctcttgaagcttatggtgctgcttacacactacaagaaatcttaacttacaagtcagatgacgttgtaggtcgtgttaaggcttatgaagctattgttaagggcgaaagaattccaaaacctggtgttccagaatcattccgcgttcttgttaaagaactacaatctcttggtttagatatcaaggtgttggatatggatcataaagaaattgagttacgtgatatggatgatgactctaacgatcatttcaacatcgatactttatctaaacttgctgaacaacaagaaaagaagaagttagctgaagaagctgcaaaaaaggatgataagccagatgaacctgtagatgaaagtgattcttcaacttcatctgatgataaggtttctaagtaatataggaggttaaacttttgatcgacgtaaataagtttgaaagtatgcaaatcggtttggcttctccaaacaagatcagaagttggtcttatggtgaagttaaaaaaccagaaactatcaactatcgtactttgaaaccagaaaaagacggtttgttcgatgaaagaatcttcggaccaactaaggactggtcttgtgcttgtggtaagtacaagggtattcgttaccgtggcattgtttgtgatagatgtggtgttgaagttacttctgctaaagttagaagagaacgtatgggtcacattgaactagctgcaccggtttcacatatctggtatttcaaaggtatcccatctcgtatgggattagtcttagatatttcacctcgtgcattggaagaagtaatttattttgctgcttacattgttattgatgcaggtgatactgatcttgaagataaacaacttttaacagaagctgaatatcgtgaaaagaaagcaaaattcggtgaccgttttgaagctaaaatgggtgctgaagctgtaaaagaacttctagaacaagtagatattgataaagaagttcatgaactaaaagaagaattaaagactgctactggtcaaaagagaactcgggctatcagaagattagacatcttggatgcctttaaaaattcaggtaacaagccttcatggatggttatggattgtattcctgttattccaccagacttgagaccaatggttcaacttgatggtggacgtttcgcaacttctgacttgaatgatttatacagacgtgtaatcaaccgtaacaatcgtttaaagagattgttagacttaaatgcaccaagaattatcgttcaaaacgaaaagcgtatgcttcaagaagcagttgacgcattaattgacaatggtagacgtggacgtccagttgtcggaccaggtaatcgtcctcttaaatctctttctcacatgttgaaaggtaagcaaggacgtttacgtcaaaacttacttggtaaacgtgttgactactcaggtcgttcagttatcgatgtttcacctgaattgaagttttaccaatgtggtgtaccacgtccaatggctctagaattatttaagccatttgtaatgcacgaattagtaaaacgtggtttagcatctaacattaagaatgctaagcgtaagattgatcgtgaagatgatgatatctgggatatcttagaagatgtaattaaagaaagaccagttcttttaaaccgtgcacctactcttcaccgtttaggtattcaagcctttgaaccagttctggtacctggtaaatcaattcgtcttcacccacttgcttgtgaagcttacaatgccgattttgatggtgaccagatggccattcacgttccattatctgatgaagctgtagcagaatcacgtttgctgatgcttgctgctcaccatatcttggctcctaaggatggtaagccaatcgttacaccttctcaggatattgttttgggtaactactggttaactcaagcagagcgtggtcgtgaaggtgaaggaatgatctttgattcaccagctgaagcagctattgcatatgcaaatggtgatattcactatcatactcgtattggtttagcagctgactcaatgccagaaaagccatggccaaagggctacgaacatggaatttttgtaactacttacggtaagttagtattcaaccaaattttccctaaggatttctactacattaacgatcctactcaagagaatcttactcacccagtagatgaaagatacttcttacaaccaggtgaagatatccatgaaaagcttgacaatatgaaacttggtcaagcctttaagaagggattcttatcagattctattgctcaaatttacaaggattacaaagttcaaagaacttctgatttcttggatgatttgaaggaactaggctacactgtatgtactacttctggtttaactatcggtgttgaagatatccctacaattagtgataaagatgatattgtagcagaagctcgtaagaaagttgatgttgtttctaagcaataccgtcgtggtttaatcactgatgaagaaagacatgatcgagtaattagtatttggaataactgtaaagacattgttcaaaatgaaattgctcaaattattcatgcaccaagaaacccaattacaatcatggccgattctggtgctcgtggtaacatttctaactttactcagcttgctggtatgcgtggtttgatggccgctcctaacggaggaatgatggaaattcctgttacttcaaacttccgtgaaggtttgtctgttttggaaatgttcatgtccactcacggtgctcgtaagggtatgacggatactgccttgaagactgccaactctggttacttaactcgtcgtttggtagacgtagctcaagatgtcattattcgtgaagaagattgtggtactgatcgtggtttaactgttcacgcaattactgaaggcgatgaaatgattgaaccattatttgaccgtttagttggtcgctacacttctaagagtgtttacgatccagaaactcatgaagtaatttgtccagctgatgtcttaatggacgaagatatggctcataagatcgttgatgccggagttactgaagtaacaattcgttccgtatttacttgcaacactcaacatggtgtatgtaagaaatgttacggtatgaaccttgctactggtgacgacgttgaagttggtgaagcagttggtactgttgccgctcaatcaattggtgaacctggtactcagttaactatgcgtaacttccacaacggtggtgttgccggtgctgcagatattactcaaggtttacctcgtgttcaagagttgtttgaagctcgtaatcctaagggtcgtgctacaatttctgaagtaactggtgaagtaacttcaattgaagaagatccagccgaacacactcgtcaaattaccgttaagggacaaactgatactcgtacttatgacgtaccatatactgcttcagtagcagttgctgaaggcgatcatgttgtacgtggagataagttgactcttggttctatcgatcctaaggaattgattcgtgtacgtgatgcattgactaccgaaaaatacattctaagtgaaattcaaaaagcttatagaatgcagggtgtagaaattgccgacaaacacgttgaagttatggcacgtcaaatgcttcaaaaggttcgtattcttgacccaggtgaaaccgatatcttaccaggtgaattgatggatattggtgaatttaaggcaagaaaccgtgaagtaattatttccggtggtattcctgctactgcgcaaagtgtaattcttggtattaccaaggccgctcttgaaactaacagtttcttatctgcagcttccttccaagaaactactcgtgttcttactgatgcttctattcgtggtaagaacgatccattacttggtcttaaggaaaatgttattattggtaagattattcctgcaggtactggtatgccagtttaccgtgaaatggaacctaaagttgatgttcctgaagatgaaaagaaaaagtcagtttattctatagctgatattgaaaagaaattagctgcagctgatgcagagaaagacaatggttcagctgactaatcgtcctttcaaaacttaaacatttgtgttaaaaaagcctattcgtgtagaaacgagtaggcttttttgtgttattagagaaaattataaaatataagacttaaaaaaataaaaggaacaaagggataggtgtttcgtttgtcaccaactatgtgattaataagtaaaagaatagaagctaaaaggaaaatatattgtgcagtataaaaatcatagtaaaaaatcagaataataaaaatgattgtatcaccatagccgaatttattttttaaattcattattagaaaaattaaaattgtagtaattattaggatccattcagttatgtcgtagcttgaaaaagaacgattgagagagataagccaaattaacggcaaaaggacaaagataggaaaagagtggtcaaaataatcaaagatactaattagaaaaataaaggtaatgaataaataggaagattgatcaagatagggatttaaaggcaaaaatgcaatcccaccgagtaattcacaatataatgcttctataggaataggtgccttgcagaaaaagcaatgtcccttatatcgtataaatgaaaatataggaatttgattaagaagggtaagaggaattttgcaactatcacagtgagatttctctgagataaaattttcctgtccaaaacgttgtacgattactaacaagtgggaaccgatgatagttccgaatataaaattaagtccataaatgaataatgttggcattttttacctccaatatttatatacgcaaaattaaaaaaagttttttaaattgtttactgaattaaaaaatcgtgttacactagccattgtgctattaaaaacatgatgtccgtgaggtcagaaaagaaactcccggatgtgtgaacaattttaggaggaaattttaatgccaacaattaaccaattggttagaaaaggccgtcactcaaagacgactaaatctgattcaccagctttaaactatgcttacaacagcatgaagaaaaagatgaactacaacccagcacctcaaatgcgtggagttgcaactcgtgtaggtactatgacacctaagaagcctaactcagctttacgtaagtacgctcgtgttcgtctttcaaacttaattgaagttactgcttacatccctggtattggtcacaacttacaagaacactccgttgttttaattcgtggtggtcgtgtaaaggaccttcctggtgttcgttaccacatcattcgtggtgctttggatactgcaggtgttgatggtagaaaacaaggccgttctaagtacggtgctaagaagggttaaacagttaataggagggactactaatgcctagaaaaggtaatattgctaagagagatgttttagcagatccagtttacaactctaaattggttactaagttaattaaccacttaatgattgatggtaagaaagcaaaggcatcttcaattctttacgatgcttttggtattattcaagataagactggtaaggaaccagttgaagtttttgaagaagcaatgaacaacgttatgccagttttggaagttaaagctcgccgtatcggtggttctaactaccaaatcccagttgaagttcgtccagaaagaagaactactcttggcttaagatggcttgtttcatacgcacgcttacgtaatgaacatactatggatgaacgtcttgcaaatgaaattatggatgctgctaacaacactggttcagcagttaagaaacgtgaagacgtccacagaatggcagaagcaaaccgtgcatttgctcactaccgcttctaatcgttagtttgtaaaaggagattaatcttatggctaacaaacgtgaattccctttggataagacacgtaacattggtatcatggcccacattgatgccggtaaaactactactactgaacgtattttgtactatactggtaagatccacaaaattggtgaaactcacgaaggtgactcacaaatggactggatggaagaagaaaaggaacgtggtatcactattacttccgcagctactactgctcaatggaaggattacagaattaacattattgataccccaggacacgttgacttcactatcgaagtagaacgttcacttcgtgttcttgatggtgccgtaactgttcttgatgctcaagctggtgttgaaccacaaactgaaaatgtttggcgtcaagctgaaacttacggtgttcctcgtattgtttttgttaacaagatggacaagatcggtgctgacttcgataagtctgttaaatcattacatgaacgtttaaatgcaaacgcacaagctgttcaaatgcctattggttcagcagacacttttgaaggtgttattgacttaatcaacatggttgctgatgtttatgatgaagataaacttggttcaaaatgggatactattccagttcctgatgaatacaaggaagaagctttaaagcgtcgtaacgaattaattgaagctgttgctgatgttgatgatggcattatggacaagtacttaggcggtgaagaaatttctaacgacgaattaaaggcagctatccgtaaagctactttaaacttagaattcttcccagtttacgcaggttcagcattcaagaacaagggtgttcaaatgatgcttgatggtgttgttgattacttaccatcaccacttgacgtaaaaccttacgttgctcatgatcctaagactggtgacgaagttgaacttatggctgacgataagaagccatttgcagctttagcatttaagattgcaactgatccatttgttggtcgtttaactttcatccgtgtttacactggttcacttcaatcaggttcttacgtattaaatgcatcaaagaactctcgtgaacgtgttggtcgtttgcttcaaatgcacgctaactcaagaactgaaatttcagaagtattctcaggtgatatcgctggtgctattggtttgaagaacactactactggtgactccttaactgatccagctcacccacttatcttggaaagtttacaagttccagatccagttatccaagtatctgttgaacctaagtcaaaagctgaccgtgataagatggatgttgctttacaaaagcttactgaagaagacccaactttccgtgctgaaactaacccagaaactggtcaaactttgatttctggtatgggtgaattacacttagacatcatggttgaacgtatgaaacgtgaatttaacgttgaagcaactattggtgaaccacaagttgcttaccgtgaaaccttcactaaggaagctaaagcacaaggtaagtttgttcgtcaatctggtggtaaaggtcaatatggtgatgtttggatcgaatttactccaaatgaagaaggaaagggttacgaattcgaagacgctatcgttggtggtgtagttcctcgtgaatttattccttcagttgaccaaggtttacaagaagctatgaagaatggtgttcttgctggttacccattaattgatgttaaggctaagttatatgatggtagttaccacgaagtcgactcatcagaagctgccttcaaggttgctgcatctcttgctttgagaaatgctgcttctaaggctggtgccgttattcttgaacctatcatgaaagttcaagtaactactccagaagaatacctaggtgatgtaatgggttcaatcactgcacgccgtggttctatggaaggtatggaagatagagctggtgctaaagtaatcaactcatttgttccactttcagaaatgtttggttacgcaactactttgcgttcatcaactcaaggtcgtggtacatttactatggtatttgaccactactcaccaactcctaagtctattcaagctgacatcatcaaaaaacgtggtggcgaagacgctgaataattttaattagagagttaaagaaaagagatatcgaaggatatctctttttttgtacaaaaaaataaaataaaatgctgagaaagcttgctatttaaggaaagacacagtacaatagtaaacgtgcgaaaatattggaggggtataccccgtgcacaaaagcaatgctttgacgcaaaaggttgcggcacaccaggctgcattgccacagaggtgagtcggtaatttttgccgagctagtcatcttttaaagaagacgaaggaggttattagatggcaagtcaacaaattcgtattagattaaagtcatacgaacatggtattctcgatgaatcagctgctaagattgtagctactgctgaaagaacaggcgcacaaatttctggtcctgttccactactacggaaagaactttattcactgttttacgttcaccacacaagaacaaggattcacgtgaacaatttgaaatccgtacacacaagcgtttaattgatattttgaatccaacacctaagactgttgattcattaatgaagcttgatttaccaagcggcgttgatatcgagattaaattataatttaaaacatatatggaggtgtaatcatgaccaaaggaatcttaggaagaaaggtcggtatgactcaaatcttcactaaaaacggtattttggttcctgtaactgttatcgaagcaacccctaacgttgttttacaagttaaaactaacgaatcagacggttacgaagcagttcaagtaggttaccaagatatgcgtgaagtattgagcaacaaacctgccaaaggtcatgctgcaaaagcaaagacttcacctaagcgcttcattcgggaaatccgcgatgtcgagcttaaggactacgaagtcggctcagaaatcacggtggactcatttagtgaaggtgacgtagttgacgttactggaactacaagaggtcatggtactcaaggtaacatcaagcgttggggccaatcaagaggtccagaaacccacggttcaagataccacagaatcccaggttcaatgggttcaatcattaaccgtgtacctaagggtaaaaagttacctggtcacatgggtggcaagaaagttaccgtacaaaacttagtaattgaaaaagttgtacctgaaaagaacgtacttttaattaagggtaatgttccaggtgcaaagaactcattaatttttgtaaaatctgctgctaaagctgctaaataggaaggaggactataatggctaatttagaaattatcgatcaaaaaggtaagtctgcaggtaatgtagatttaaatgaagaaatcttcggtattgaacctaatgaaagtgttgtttttgatgctatcattagacaaagagctggtaagcgtcaaggtacttctgctgtaaagaacagatcagctgttcgtggcggtggtaagaagccttggagacaaaaaggtactggtcgtgctcgtcaaggttctattagagctccacaatggcgtggtggtggtactgtatttggcccaactcctcgttcatacaagatggatatgcctcgtaaagcacgtcgtttagctatgaagtcagttctttcccaaaaagttgctgacaatgatctaatcattcttgatcaattaactttagaagcacctaagactaaagaattaaaagctatcttagataatgctaatgtttctggtaaggttttagttgtgtctgatgataagaatgttcaattatcaggtaagaaccttccaaaagtgaaagttgtacctgttaatggcttaaatgttgttgatgcggttgactaccaaaaacttgtattaactcaagacgctattaagagaattgaggaggttttggcataatggatgcacgtgatatcatcttacggcctgtagttaccgaaaaatccatgaacttaatggatgataaaaagtatacttttgatgtgcttgtatcagctaccaagactcaagttcgtaatgcaatcgaagaaatttttgatgtaaaagttaaaaatgttaacattatgaacgttcgcggtaaagaaaagagagttggtcgttacactggtaagactgctcgccgtagaaaagcaatcgttactttaactgaagattctaatgacattaagatcttcaatgataataaagaaaattagtaaataggaggtcagtcaattggcaattatcaaatataagccaactacaaacggcagacgtaatatgacttcttccgactttgctgaaattaccaagaaaaagcctgaaaagactttacttgaatctcaaagtcatactgctggtcgtaactcatacggtcatattactgttagacaccgtggtggtggtcacaaacaaaaataccgtatcattgacttcaagcgtaacaaggatgatgtaaaagcagttgttaaggctatcgaatacgatccaaacagaactgctaatatcgctcttcttcactacactgatggtattaaagcttacattttagcacctaagggtctaaaagttggtgctgttgttgaatctggtccagatgctgatattaagccaggtaatgcattaccattatctgctattccagctggtactgaaattcacaatattgaattaaagcctggtaaaggtggacaattagtaagaagtgctggtactgttgcacaagttcttggtaatgatggtaagtatactttagttagacttcaaagtggtgaagttcgtaagattttatcaacttgccgtgctactatcggttctgttggtaatgaacaacactcattaattcaattaggtaaagctggtcgtagtcgttggttgggtaaacgtccacaatctcgtggttccgtaatgaaccctaacgatcacccacatggtggtggtgaaggtaaggctccagttggtcgtccacaacctatgactccatggggtaagaagtctcgtggtattaagactagaaactctaaggctagaagtgaaaaacttattattcgtcaccgtaaaggtaacaaataattaaacgaaggaggttaattaatgagccgtagtattaaaaaaggtccttttgctgatgcaagccttttaaagaagatcgaagcccaagaaggttccgaaaagaaacaagtaattaaaacatggtctcgtcgttcaactattttcccttcctttgttggtttcacaatagctgtttacgatggaagaaaacatgtgccagtatacattactgaagatatggttggtcataagttaggtgaattcgtacctactagaactttccgcggtcacaaggtcgctgataaggccactactacagtaggtaaataataggaaggagagacatctaaatggcagaacaaattagttcagctaaagctgaagcaagaacagttcgcatcgctcctagaaaagcccgtttggtagtagaccttattcgtggaaagagtgttgctgaagctctcgcaatcttacaatttacgccaagagctgcttccccaatcgttgaaaaagtattgaagtcagctattgcaaatgctgaacacaactacgatcttgaaagtgcaaacctttacgtatcagaagcatacgttaacgaaggtgcaactttaaagagattccgtccacgtgctaagggtatggcttctccaattaataagagaaccagccacgtagtagttgtagtatctgagaagaacgattaagggaggtaaatttaatgggtcaaaagattaacccaaatggtttccgtctcggtgttaaccgtgattgggaagcaaagtggtatgcagacaaaaactacgctgacactttaaatgaagatttacgtattagaaagttcatctctgaaaagttagctgatgcatctgtttccactgtggaaattgaacgtgctgcaaacagaattaacatttctatccacactgctaagcctggtatggttattggtaaaggtggtaaggaagttgaagctttaagaaaagaacttagtgctttaactaacaagaacgttcacattaatattgttgaaattaagaagcctgatttagatgctaaattagtaggcgaaggcattgctcgccaacttgaagcaagaattgcatttagacgtgcaactcgtcaagcaactcaaagatctatgcgttctggtgctaaaggtatcaaggttcaaactgctggtcgtttgaatggtgctgatatggcaagaagagaatggcatactgaaggtagtgttccacttcatactttaagagcagatattgattatgcttgggtagaagctgcaactacttatggtcaaattggtgttaaggtttggattaaccgtggtgaaattttaccacaacgtaagaacaaaccttctaagaaagcgaagggaggaaactaatagtgttagtacctaagcgtgtaaagcaccgtcgtgaattccgcggtaaaatgcgtggtgaagccaaaggtggaaagaccattgcatttggtgaatatggtttagaagctgttgaatctcactggattactaatagacaaattgaagctgctcgtattgctatgactcgtttcatgaagcgtggcggtaaagtttggattagaatcttcccacaaaaatcctacactgcaaaaggtgttggtgttcgtatgggttccggtaaaggtgcaccagctggttgggtagctgttgttaaaagaggcaagattatgtttgaaatcggtggcgtttcagaagacgttgctcgtgaagctttaagacttgcttcaaacaagcttccaattaagactaagtttgttaagaagagttcggaagtaggtggcgaatctaatgaaggctaaagatatcagagcattaaccactgatcaaatgttagaaaaggaaaagcaatataaagaagaactttttaatttgcgtttccaacaagcaacgggtcaattagagaacaccgctcgcttgagacaagtccgcaagaacattgctagaattaagacaattcttagcgaaaaagaattgagcaagaattagttaacggaagggagttattaacttgagcgaaactaacgaaagaaataatcgtcacgtataccaaggtcgagttgtttctgacaagatggataagactattacagttgttgtagatacctacaagaaccaccctgtttataagaagcgtatcaagtactcaaagaagtattacgctcacgatgaaaacaacgaagctaagattggcgatactgttcgtatcatggaaacccgtccattatcacatgcgaagcgttaccgtctaactaagattgttaagaagtcaatttaattacgcggattttattgaggggaggataaactagtgatccaacacgaaagccgtttaaaggttgctgacaactccggtgcaagagaactcctagttatcaagattttaggtggttctaagcgtaagaccggtaatattggtgatatcgtagttgctgctgttaaacaagcaacaccaggtggcgttgtcaaaaaaggtgatgttgtaaaagcagttattgttagaacaaaatcaggtgcacgccgtgaagatggttcatacatcaagttcgacgaaaatgcagcagttgtaattaatgctgataagagtcctcgtggaactcgtatttttgggcctgtagcccgtgaactgcgtgagcacgatttcatgaagatcgtatctcttgctcctgaagtcttataattttttagggaggtgcactgatgtttgttaaaacaggtgacaaagtaaaagttattgccggtaaagataaaggcaaagaaggcactgtactttcagtcaacgccaagactaaccgtatcgttgtcaaaggtgttaataagatcaaaaagcatgagaaaccttcacaaaccaacgctaatggtggtgtggtagaaaaagaaggttctatccatgcatctaatgtaaaagttattgctaaaaaagaagataacaacaaataggagggaggacgcacatggcaaacagtttagtagaaaaatactcaaatgaaatcgcaccagctatgaacaaaaagtttaattacgattcagttatggaaattcctaagattgataagatcgttttaaacatgggtgtcggtgatgcagtttctaatgcaaagaatcttgatgaagctgtagaagaattgactttaatctcaggtcaaaagcctttgattactaaagctaagaaatcaatcgcaaacttccgtttacgtgaaggtatgtctattggtgctaaggtaactcttagaggcgatagaatgtacgatttcttgtacaaattaatcaacgtttctcttcctagagttcgtgatttccgtggaattagttctagatcatttgatggtcgtggtaactacactttaggtatcaaagaacaattaattttcccagaaattgattacgacaaggtaaaccgtgttagaggtttggacgttgttattgtaactactgccaagacagatgaagaagctcgtgaacttcttactgagtttggtatgccttttgctaaataatttggaggacattaatggctaaaacatcacaaatcgtcagaaatcatcgtcctgctaagttttcatctcgtgaatacactcgttgcgagagatgtggccgtccacactctgtttaccgcaagttcaaattatgccgtatttgcttaaaagacttagcacacaagggtcaaattcctggtgttaaaaaggcaagttggtaattaacggtaaaggaggcaaattaaatggtcatgacagatcctattgcagattacttgactagaattagaaatgccaacatggcaaaacatacttctgttgagattcctgcatcatcaatgaagaaatcacttagtgaaatcttaaagaacgaaggctttattcgcgattaccaagttgaagatgataacaaacaaggtatgatcaagattttcttgaagtacggtcctaataacgaacgtgttatttcaggtttaaagcgtatttctaagcctggtttaagaaactatgtaagtgctgaaaacttaccaaaagttcttaatggtcttggtattgctatcatttctacttctgcaggtgtgattactgataaagaagctagagaaaagaacgtcggcggcgaagttattgcttacgtttggtaattttgacagaaaggagaactattaatgagccgaattggtttaaaggtcatcgaggttcctgaaaaggtcacagttaccaaaaatggtgacgacatcactgttaagggaccaaaaggtgaattaactagatactttgatccacgcattacctttgaacaaaaagatggagaaattcattttagtcgttcaagtgaagctgacaaagctcttcacggtactgaaagagcaaaccttgcttccatgattgaaggtgtaactgatggatatgttaaaaagttaactttagttggtgttggataccgtgcagttgcacaaggtaagaaattaactttaaatgttggttactctcacccagttgaatttgaagcaccagaaggtattactgttaaaactccatcagcaacttcaattgaaatcgaaggtatttcaaaacaagttgttggtcaatttgcggcagaaattcgtgacgttcgtccaccagaaccttacaagggtaaaggtattcgttacgaagacgaatatgtacgtcgcaaggaaggtaagactggtaaataataaatagaaaatttttgaggtgaaattgtgatttctaaaccagataaaaacaaattacgcttaaagcgtcataaacgtattcgtggaaagatttctggtactgctgagcgcccacgcttaagtgttttccgttcaaacaaaaacatctacgctcaattaattgatgatgtagagggtgtaacgcttgcaagtgcctcaacaaatgataaaaatatttcagcagaaggttctaaaatggaacaagctgctgaagtaggtaaagctttagctgaaactgctgctaagaagaacatcaagagtgttgtatttgacagaagtggttacctataccacggtcgtattcaagctcttgctgatgcagcacgtgaaaacggattagaattctaggaaaggagaattaactaatggcaaaccgcaacgattctcgtagagattctcgtaaagatcgtaaaaaagacgatattgaagatcaattagtagcaattaaccggatcaccaaggttgttaagggtggtcgtcgcatgagatttgctgctgttgtaatcgtcggcgatagaaaaggtcatgtaggttttggtactggtaaggctcaagaagtcccagaagctatccgcaaggctgttgaagctggtaaaaagagaatgattaaggtacctactgttggtactactattccacatgaagttatgggccattacggttctggtaacattatgttgaagcctgctgaagctggttctggtgttgctgctggtggtgctgttcgtattatcatggatttagcaggtatttcagatgttacttctaaatcacttggttcaaatacaccaatcaatgttatccgtgctactatggacggtttgagtaaattaaagactcgtgaagatgttttgaagcttcgtgagtcagcaaaaagcttagaagattaaggagattaaataatggatttaaaagttaccttaattaaaagcgtcgcacaccgtcttccaaaacaaagaaaaattgttaaagctcttggtcttggtaaggtaaatagcactgttgttcttccagacaacgctgcaactcgtggcgctttattgaagattgctcacctgatctcagttgaagaggttaataagtaattagaatccaaggaggtgccaattaatgaagcttaatgaattaaaaccaaatgaaggttcacgtcgcaacagaaaacgtgttggtcgtggtacttctagtggttacggtaaaactgctggtcgtggacaaaagggtcaattagctcgtactggtggtaagactcgtttaggtttcgaaggtggtcaaatgccattattcagaagaatgcctaagcgtggtttcaagaacgttaaccgcaaagaatacgctattattaatttaaatgatttaaacagatttgatgatggtagtgaagtaactatcgatacattaaaatcatcaggtttagttaaaaaagaacttgcaggagttaagttgttagctaacggtgaattaaaggttaagttaactgtaaaagttaacaaagcctcagaagctgctaaaaaagctgttgaagccgctggcggaactgttgaggtgatctaatgttctcgaccttgaagaacgcctttaaggataaagatattagatcaaaaatcttctttactctctttatcctattgctttatcgaatcggagctaatattacggttccgggtgttaatgcaaaagctattacacgggttgcacaaactggtttagtcccaatgttggatacagttagtggtggtggattagatacttattctattttttcattaggtgtttcaccttacatcactgcccaaattgtcattcaattactccaaatggatattgttcctaagttagttgaatgggggaaacaaggagaagtcggaagacgaaaaacaaatcaggtaacgcgctatcttactttagtcgttgcttttgttcaaagtctaggaattactcttggttttaacgttttaactgaaatgggtttggttaaaacgcaaactcctcaaacctatattgagattgccattattatgactgctgggacaatgcttttgacctggctaggtgatgaaattactgataaggggctcggaaatggtgtatctgttattatttttgcaggtatcattgctcgccttccaaatggaatttatcaactatataaagatttcatcattaataatagtgctagcgatcgttggcaagggattttgttcttcatcgcgatcattattgccattttactagtaactcaatttgttacatggtttcaacaagctgatttacgagtacctattcaatatactcgtagagcagcaacaagtggctccgaaagtttcctaccattaaaggttaacgtgtctggagttattccagttatttttgccagttcctttattattacaccagctacaattttgatggctttccaaagatctcatggaaatgaacaatggtttaagatttgtaatcaaatatttagtttacaaactacacctggtgcactgatttatacactattgattattttgttcactttcttctatgcctttgttcaagtaaatccagaaaagttggctgagaacttgcaaaagcaaggagcctatattcctagcgtttggccaggaaaagatacacaaaaatatgtatctaaaattttgattagattatctacagtaggtgcggtatttttagggctagttgccttgttaccacaacttgctacaaatatttttggtttaccaagttcaattggtcttggtggaacgagtcttttaatcgttattggtgttgttttagaattagctcgtcaagttgatgggttactaatgaaacgcgaatacgttggatttattagatagtaaggataaaaatgattaatttaattcttttaggtttgcctggtgcaggcaaaggaacagcttctgaaagcattgtggataagtatcacttagcacatatctctaccggtgatatgtttagagaagctatggctaatgaaactcctgttggtttggaagctaaaagttatattgataaaggaaatttggtcccagatgaagttacagctaagttagttgaagaacgacttaagcaacccgacactaaaaacggattcatcttggatggatttccaagaaccactgttcaagcagaacttcttgaagatataactaaacggttggaaaaaccgttaactaatgtaattgcaattgatgttgatgaagatgttttgatcaaacgtttatcagcacgttacatttgtaaaaaatgtggtgcaacttacaataagatttcaaatccaactaaagtagaaggtacttgtgatcgttgcggaggacatgaatttttccaacgtgaggatgacaagccagaagttgttaaaaatcgcttagaagttaacaagaaaatgaatactcctcttcgtgatttttatgaagaaaaaggaattctttcaactgttaacggtgaacaaactccggaaaaagtatttgaagacattgacaaaattttaagtaaagactagtctgttattgtttttttacaattccgtgttataatgcctaagtgtgactatttgttcatgtggaggaacaattttggcaaaagaagatgtcatcgaagttgagggtaaggtagttgataccttacctaatgctatgtttaaagttgaattagaaaatggtgcaactattttagctcatgtgtctggtaaaattagaatgcactacattagaattttacctggtgatagagtaacagttgaattatcaccatatgatttaactaagggtaggattacgtatcgttttattaagtaattacggaggcaaacatgaaagttagaccatctgttaaaccaatgtgtgaacattgcaagattatcaaaagacagggtcgtgttatggtgatttgctctgcaaaccctaagcacaaacaacgtcaaggttaatagttagatatttttattaggaggtgcaatttaatggcacgtattgctggtgttgacttacccagaaataaaagagttgtagtcgcattaacttatatctatggtattggtgaaccaactgcaaaaaagatttgtaaagatgctggtatttctgaagacattcgtactaatgacttgactccagaagatcaagaaaaattacgtagcgaagtagacaagtaccgtgttgaaggtgatcttcgtcgtgaagttagccttaacatcaagcgtttagttgaaattggctcataccgtggtattcgtcaccgtcgtggcttaccagttcgtggtcaaaataccaagaataatgctcgtactcgtaagggttcaaagagaaaataatttattaaataggaggttaagttaatggctgcaaagaaaacagcacgtaaacgccgtgtaaagaagcatgttgaaagcggcgttgctcatattcattctacgtttaacaataccttggtcatgattactgatgtacaaggtaacgcagtcgcatggtcttccgctggtgctttaggttttaagggtagtcgtaagtctacaccatttgctgctcaaatggccgcagaagcagctgcaaaatctgcaatggatcaaggcatgaagcatgttgaagtttcagttaaaggcccaggtgcaggtcgtgaagctgctattagagcacttcaagctgcaggtcttgaaatcactgctattcgcgacgttactccagtgccgcacaacggttccagaccaccaaaacgtcgtcgtgtctagtttattcctgcgtgcaggacattacgttttgaaaggggcccagtaatgattgaatttgaaaaaccaaatattaccgtagtagaccaagaggaggcatacggtaagtttgttgtcgaaccactggaacgcggtttcgggactactttaggtaactcactccgtcgagttttacttacttctattccaggtacggcactttcttacattcagattgatggtgtgttacatgaattttcaacaattcctggcgttagagaagacgtcacgaagatcattcttaatttgaagaaactagagttaaagtcactctcagatgaagaaaaaattgctgaaatcgatgtaactggaccagcaattgtaactgctgctgatttgaaggtcgactctgatattgaggtcttaaatccagatcaatatatttgtagtattgctgatggtggccatttgcatatgaacgttgcgatcaagactggtcgtggttatgttcccgcaagtgaaaacaagacagatgacatgcctattggtgtcatccccgttgattcactcttctcaccaatcaaaaaagttaactaccaagttgaaagtgctcgtgttggtaagagagatgactatgacaaattaactttagaaatttggactgatggttcaatcacacctaatgatgcccttagtttcgctgcgaagattcttgtagaacacttcaaagtatttatgtctactgatatggatgcgcagtttgatgatgtaatggtagaaaaagaggacgataagaacgaaaagaagcttgagatgacgatcgaagagcttgatttgtctgttcgttcctataactgcttgaaacgtgcaggaattaatactgttcaagaattaactgataaatctgaagcagatatgatgcgcgtacgtaacttaggacgtaagtcattagaagaagtaaagaataaacttgccgatcttggtctatcacttcgtcaagatgactaagtaggaataataaggagggaaaactcatggcataccgtaaattaggtcgcgatagtgcacacagaaaagcaatgcttagagaaatgactactcaattgatcatgaacgaacgcattgttactactgaaacccgtgctaaagaaatccgcaaaactaccgaaaaaatgattactttaggtaaacgcggtgatttaagtgctagaagaaaggcagctgcttttgttcgtaatgaaattgctgatattcatgaagaaaaagatgcagttgttgtaaaatcagcacttcaaaaacttttcagtgacattgcacctcgttacaaagatcgtaatggtggttacaccagaatgtacaagttagctaacccacgtaagggtgacgctgctccaatggtaatcattgaattagtttaattaggtaaaatataatattattttataaatctttcacaaaagcgagaataagcgtgatgatggtggcttttgcctagtctagcttagatgttaaatcatccctctttgtggatgatttttttttgctctttttttatatataattgatacaatgacatattatggaaaaagagcagtgaatatttatgaaagataatatagtaacggttaagcatctttcttttacctataaagatagtaaagtacctgctgtaaatgatattagtttctcaattcctagaggatcatggactactttggtaggtcataatgggagcggaaaatcaacaattgcccgtttattggatggcattcttttaccccatgataatcctagaacggtaattaacgttgatggtattgagctgacagagaaaacaatgtgggatattagagaccgtgtaggaattgtattccaaaatcctgataatcaatttgttggtgctacggtggaagatgatgtagcttttggtcttgagaatcgtcaagtttctcgttctaagatgcagactattgttcatgatgtgcttgagcaagtggatatgcttgactttcaaaaaagcgaacctcaatatttgtctggaggtcaaaagcaaagagtagctattgccggcattttagcgattggaccaaaattaataattttagacgaatcaactagtatgttagatccagcaggtaaaacgaaaattcttagccttatacgagatttacaaaataaaaatggtctgactatcttctccattactcatgatattaatgaagcggtacaagcagaccagatgttagttttagataaaggaaaattattggctagtggctctccaagagagatatttgaaaacgaggttttaataaaaagtgccggattagagctccctttattttataaggttaaaaatgaacttataaaaaaagaaattcatatccctcgagaagtcaatagtgaggaaaagttggtgaagtatttgtgtcaattgaattcaaaaatgtagattatgtttatgcacctggaactccatttcaaactcaaggattgatagatatatcttttaaaatagaaaaaggatcctttgtagcaattgctggccataccggaagtggaaagtctactctcatgcagcattttgatggcttattgcttccaagtaagggtgaaatcactgtagcgggtgagcagattaatgcaaatacttcaagcaaggcactaaaagcaattcgaaaaaaagtgggcctagtgtttcaatttcctgaaaatcaactatttgaagaaactgtgcttaaagatgtgatgtttggtccacttaattttggcttttcagaacaaaaggcaaaagagcaagcagtagagtggattaaaaaagtaggcctttctgaagatatgatggataaatctccttttgaactttctggaggtcaaatgcgtcgcgtggcaattgcaggtgtgatggcatatgaaccagaaattttatgtcttgatgaacctgcagctggactagatcctgaaggacagaagcaaatgtttgagatatttaaggagtaccaacgagctggccatacagtcattctaatttcacataatatggatgatattagtgaatatgcagatgatatgttagtccttgatcatggtcatttaataaaacatgctagtccacaagagattttttctgatcaggagtgggtaaaaaaacactatctcgatgaacccgcaactagtagactaactcgggagctacaaaaaggtggttttcaattttcagagatgccactaactattgagtcgttagtaagtaaagttgcaaatgagctaaagaagaagggggacatggatgagtaaaattattattggacgttatattcctagtaattctatcgtttataaaatggatcctcgaggaaagataattgcaacatttttatttattgttattatctttctggctaataattggttgtcctacttctttttatcgatatttactttacttgctgtttgggcaacaaaattaaagcctaaagtattttgggatggagtaaagccattaatttggttaattctatttacttcagttttgcaattgttttttactacaggtggaaaagtttattggcagtggggaattttcaacattagtgaatatggtattcagaattctatttttatctttattcgttttgtaatgattattctgatttcgacagttcttacgctgacgaccacatcattagaaattgcagatggaatggaatggatcttaaaacctcttggctacctaaaagttccagtagctcaaattgctcttgtaatgtctattgcgcttcgctttgtgccgacattattagatcaagcagtacgaattatgaatgctcagagagcacgtggagccgattttaatagtgggggcttaattaagagaattcattcgattatcccaattttaattcccttatttattagttccttaactgttgcaattgatttggctacggctatggaagcaagaggttatcgagaaggggcaaaaaggacgcgctatcgagttttaaagtggtcaaagtatgattggattaacttaggttattttgcgctattgacgctaattttattacttacaaggacgtattaattaatgactacaagatataaattaaccatggcctatgatggtcatctttttcatggatttcaaattcaaccgaatcaacgaactgtccaaggcgtgattgaagaagcattaaaaaagatgactaaaggaaaaagagtggtagtgcacggatctggaagaactgatgctggtgttcatgctaaaggacaagttattcactttgactatccaggaaaagaaattccagctaaaaatatgatgcttgctttaaatgccctcatgccgattgacacagttttctttgaaagtgaaattgttgatgaagattttcatgttcaatattcaactaaaggaaaatggtatcgatatgtagtggatcaacatcgttttacagatccttttaatcgtttttatacaggccactatccctatcctttagatatttcgctaatgaagcaggcagctaaagatttgattggtgaacacgattttactagttttgctgctagcggtggacaaattgtggataaggtgcgaacaatttactatgtgaatattacgccagacccagataaaaaacagatcatttttgattttattggaaatggctttttatataacatggtaagaatcttagttggaactttgttagaaataggcaataaaaaaagacctgttgatgatataccaagagttttaaaggcaaaagaccgacaagaagttcgaactactgcaccagccagtggactatatttacaacaagttttttatgaagatattcctaaaaaatatcgtttggaccttaaaaaggattgacttttcaggcaaaacgacgtaaattagtatacgtatgtttgtccacgataggccccggaaacttattgtttgtcaaacagaagaaaaacggaggaatttaaagtgcgtactaccccattagctaaaactagtgatattaaacgtaagtggtatgttatcgatgcgactgatgtttcacttggtcgtttatcaactgctgtagcatcaattttaagaggtaagaataagcctcaatatacaccaaatgttgatactggtgattatgttattgttgttaacgcagctaaattgaagttgactggtaaaaaagcaactgataagatctactaccgccactcagattaccgtggtggcttaagagctactcctgccggtgaattattagctaagaacccagtaagattagttgaattatctgtaaaaggcatgttgccaaagaatactcttggtcaccaagaattcatgaagatgcatgtttacgctggtgaagaccacgaacacgcagcacaaaagcctgaaaagttagacatcaacgaattaatctaggaggttttaaataatggcacaacaagcagcttacgctggaactggtcgtcgtaaagattctgttgcccgcgtacgtttagtaccaggtaacggtcaaattaccattaacaaagaagacgtaactaagtacattccataccctaacttggttcaagatatgaagcaaccattagcattaactgaaactgaaggtcaatacgacattttagttaacgttaacggtggtggtttctcaggacaagctggtgcaattcgtttaggtattgcacgtgcacttcttgaagttgacccagatttccgtggtcctcttaagaaggctggcatgttaactcgtgacccaagaatgaaggaaagaaagaagccaggtttgaagaaagcccgcaaagcttcacaattctcaaagcgttaatattttatattacgttttatgcaaaagacatctcgaaagggatgtcttttttgtttagtatgtgatagcatacatttaatcttaattactaaaaaattgtgagtagaagtgaggaaaatattatgaacatggataaaaaagatctgaaagaagacctatatgttgcttatagtgtatgttttgtactattagtagcttctatattttccgatctgatatcatggtcatgggtgcgcacatttgttagagtaggattcggattatcattaatagatacacttaatgatcaatggaagtattttaaattgagaaaagacatatcaaaatcatagatagctgtgaagtaagacctaaaggtgaaatacttttgggtcttttttctgtctaaatttaataagaaaaaaagatagattgaatatttcataaaatagtaataatattaaatctatcttaatattttggagtaacacaaattaacattaaaggtatttttaatacgaataaaataagattcattagtatttgtatcttattaatcctagagacagctagtgcaacaagtgttacatatttaatgacacctgcatttaattatataaagcaaaataaattaaatttatttttaatatttattactttatcagctagcttgcaatttataagtacaattttaacttcccttggtaatattctatatgctcatcaaattcaggattatattcatcagattcggaataatattactagatatctatttgttaatgacgatgaaaatgtgtctgaaattcaaaataatctaaattcgaatattcaggaattaactaataaatataccaatcctttattcattttatggcgcaggatattaactattgctttttctctgggagtcttatttacctttaattggagtttagttgttttaactttgttgctgtcttttgtcggtctttatttaccaaaactttttgagaaaatgacatcttccgctactcttgaagttactcaaaaaaatgaatatctgcttgatacagtagagaaatgggctcgaggattagatgaattaagaaggtatgccagttttggcagctatgaaggtgcaataaagaaatcaacctcggagttaaaagcagctacaattcaggattgcttctggggaaatttggcgactgcacttacatctctaatatctttaataggcataattttgctattagcactttcaatatatttgtatgcgacaggacagattgtctttggtgctatcattacttctggaatttttgcaaatcaaattatgaatgctattacctatttagcggaaagcctcaatcaaattaaatcttctaagaaagtgcgccttaagattcttaacttgcaagaatcagtacaatttaatgtaaaagacaattctgataaaagaattaacaagattgaaattaatgatcttcaagtctcttatccaaatggagaaaggatttcttatccacatatagtcgttaacaaaggggagaagatactcttaactggagatagtggtagtggaaaatcaactttatttaaagttttactaggtgaagttacacctaaaatgggtacagttagctataaagataaagaaggaaaagtatttataccgaatccagaagaaataggatatcttgcacaagataatacgctttttcccgatactatcaaaaataatattacaatgtttgattccaagttagataaggaagttaataatacaatcaaaaaggtaaatctttctactgatattgaaaaatttcccaagggattaaaaactttaattaacttagactctgaaaacttatctggtggtcaaaaacaaaagatagttttagcccgagctaacatccatcatagtagcttgctcttgattgatgaagggacgagtgccattgatagtaaggcaactttatctatcttaaaagaattattgaagtcagaacaaaccattattatgattgctcataatctttcgcaaaagtcgattaatatgtttgatcgagagattcatttgaataaagaggtgaattaaatgtcttttcgaggatttatcaatactaataggactcgtttcttttggattactattttatcaattttatcagggatgagtggtattctggctggctatatacagatgtattggttgacctatattaaagagaaaaattggaatgaggttatagttacaactagcttaatggctctatgctggttctttgctcaatcagtgatttattttgttcaatatttaaataatgttcaagaagaagaatatttcaagaaattacgcgatgaaatagccgagcattattttaaagatcaaaaatttcatgaagtagccgcttttcaaaatagactaactaatgatttcaacattgtaaaaaataacttttttgaatggtatgtaactgttcctttttatggatcgatgttaataacctctttgattgcgttactaacaatccattggtcaatttttgcattaagtttagttgtagatactgtttcatattttttacctaaactaattagtaaaaaaatagagaaaactacaattaacgtttccgataagaataaagaatatcttgcgatattgagtaaatggttttctggtttaagtgaattaaaaagatactttgcaggtaataaattattagaagtgcagagcaaagcatcaaggagactagaaaaagcaaatattaatcaaacgattcaagaacagatattaagtatcttaaatggcttcagtgctttggtttctacaattctattattaggatttactggagtattagttgaacaaaagttagtcatttttggtgcgattttatcagtacaaaattttgcggataatgtggcttttggaatgcaagaaactattgaaggattgacaatgatgcgttcctcaaaaccattaatgaataaaattagtgaagatacagcactacttgaatcgaacaataaagaagaggccagtattccttccgtaattaaaactaattcattgtctctgaaatttcctaatggtgaaatgttgaagtatcctgacataaatataaaagagggtgaaaaaattctcttaactggtgattcgggatcaggtaagacaaccttatttaaattactattaggaattattaaacctagttatggaacgatagaatttgaagaccaggatggcaatactgttacacctgatatgtctaaaattggctatatcccacaagaacctaatctttttcctgggacaattaaacaaaatattacgatgtttaatagtcagcttgataatcgagtaaacttggcaataagggatgtcaacttagatgatgacatgaaaaagtttaaagatggcgtaaattctccgttaaacttagacaaattaaatatttctggtggacaaagacaaaagatcgttatggcccgtgcacaaattcatgacagtaaaataattttaattgatgaagggacaagtgctattgatcaacaggctacttttaagattttaaagaaattattgcaaactgaggcaacaattgtttttattgctcataattttaatgaaaatatgcggaatttgtttgatcgagagattagactatgaaaattttagacagggaaaaatataatgacaacagtctattttgtaagacacgctgaaccagatttaagtaatcataatgatttgacaagagatttaactccaaaagggatagaggatcgaaaatttttaattgattactttaaaaataagaaattagacgtggcattttcaagtccttttagaagagcaattaggactattgagccagttgctaaaagtagaaatttaaaaattaaccaaatttcggaattttgtgaacgtaaaattggcgatgagtggatttctaattttcatgaatattgtcaaaaacagtggtttgattttgactataagttagaaaatggtgaatctttgaatgatgttcaaaaaagaaatatgaacgcgttaaaaaatcttttaactgatcgctgattgtaaaattaaattgaacacttgataaaaaataaaaagtccattcggacctgtttgatagaatgttaataaccacaaaaactttctattggaggtcaaaatggactctttacattctaccatgaaccagcacgttaaaggcaagcatttatcatttgaagagcgagttattattcaattgcgtttgaaagatggctattctttgcgtgcaattgcccgtgaacttaactgttctccttctactatcagctatgaggttaagcgtggcactgtaaaactgtatcatggtaaagtcaaaaaatataaggctactcaagggcatgatgcatataaagctcatcgtaaaaattgtgggcgcaaatcagactttctcaggaaagctcaattcatgcgctatgtccacaagcatttttttaaagatggctggtcgcttgatgtgtgcagtaatcgtgctactgctgttggcgaattcgctagcagcgatgttgtctgcaccaaaactctttataattacgttgatcaaggcttattaggaatttataattacgacttgccagagaagcttaaacgcaatactaagcttcatcgtattcgcaaaaataagaaaaaacttggcagaagcattgaagaacgtcctaaagagatcaataaacgtaatgaattcggtcattgggaatgcgatttagttctcggacataagagcaaagatgatgaggtactgctaaccttatctgagcgtatgagtcgtgagtttttaattcttcgtattcctgacaagacttctgtcagtgtcatgcaggcctttaaagaactccaaaggcaatacagcgaacattggaatgatatttttaaaaccattaccactgataatggctcagagtttgcagatctttccaacctagaaaaagtatccaatacactggtttactatgcccatccttacacttcttgtgataagggaacagttgaaagacacaatggtcttattcgcagattcattcctaagggagaagcaatagctaactattctttacaagacatcattaatattgaaacctggtgcaattctttgccaagaaagatactggcctatcatacaccagatgaaatctttgaaagagaattagatctaatctatcaagcagcttaactaaaagtgttcaatttattattgcaatttgctaaaataatccatttgtaatgtctccattttatgcatatgtaccaaggagacttgctagctcaggaattgaatacagtattataaaaaatagtttgtatgcagatccactggtcccatatatagaagaactaattaaacgaaaaaatattatttatccagttggggcagaaccactatcctttattacaagaaatgatagtgctcatgcaattgcgtgtttagcaatgcagccagtaatgcgcgatcaaggccaaacatatctattaagtatggacaaaaattataacatggttgagctatcatacattatgtctcggatcactgatcataaaattggctatgcacctgtaacaacgggtgaatttgcaaagatttatgccgctgaaggcgatggaaaagaacttgcatcaatgtatgccggaggagcgaagggacttcttagtgcaacatctgatgactttcatcgcttaactggtagagaaccagaagaaatggaacattttttaagaaatggctatcaaattgcacgtttataaaataaattagtttaatttaaaataaaagatgttataataaatatagtaagtgcttagagaaaaattaattgtaattaagtgtagtgcagtgctgagacaagaccgtaagcttgctattaactacacaagcttttaatttaagggatagattaaaagttattttagctgttatatacgaaaaaagagatcagatataaaatctggtctctttttcgatatgtttaactataggctttgattaatatttttagctagataatcataaagcattgctttttctaattctttggtgtcataacctaaagtttgagcaattgtataagcgtatgcccaagctgtagctggtccacgactagtgataattttgtgttctttatccacaactgtaatatcagtgctaaagtggccgtttggacattccttttcaatttctttttcaaagcctgggtaacaggtgtagttggctccttctagcaagccgtagtgacctaaagcaatcggagcggcacacattgctgcatcccatttgccttctttatttctttgaatcataagcttagctaatttttcattgtttctaaggtttaaagctccagttcttccacctggaaaagctactaagtcatactctaaaagtgaatcatccacaactttatcacaggttagtaagatatgatggtctccgttaatttcttttttatcaagaccgaccatgtcacaatcaatatctaagcgacgtagtacatcaacgacactaagtccttcaacttcttcacagccatccgcaaagacaacagcaactttcgtcataaaaaagtcctcctttttattaagcactatacaacttttattttaacccattaaaatagtaatttttaatttaaagattaaaaaaataaatccaaaattgcgtacataataatagctaacctatgagatattgtactaataattttgtgaaacactaaatgtagtgttacctttaaaaatacttgaattaacgcaatattctgttaacatttagataattgaaagaaaatttgtgaaacaatttaagaaaagagggtaaaaatggctactgaagtttatttagtaagacatggggaaacaatgtttaatcagttgaataaagttcaaggctgggctgattctccactaactgtaaaaggaattaatgacctaaaagtaacagcatctaatttatctcaggttcattttgataaaatgtatagttctgatttaaagcgagccattgatacagttcacttaattgccgatacaaatgaagtttctgagattggtaaaataaaaaaacttccagcttttcgtgaagtattctttggtacttttgaaggtgacgatattgacgaaacttgggaaaaagttgctgtagctggagggatgaaaccaacaaatgatgtggtaaaaatcattcaaaccttaggaatccatgattttcgtgaagcaactaagaaagctgatccacgtcatttagcagaagatgcagaagccctcaataatcgaatggaccaagccgttagccaactagctgaagaaacaaaagggctaggacgagttttaattgtgtctcatggagactttattaagactttgggaattaaatactgggatcaaactacgcatgatcacgatattccctttccagacaatggcagtgtgacgcgtggaataattgatgataatggaaaatttaaaataattaattatggtgtaaaaaacactgacattccaaatttataagatgcagctatcaagttgcatcttttttagtataagtttgtgggatgttctttggcagtatgttctacatgttcaatcatggcgtcaatcattgataaaacatcaggatcatttaaaaaataaaagacatgagttccatgtttatgatgtttaaccaaattgtatttttctaaaatgcctaattgttttgatacaaccggctgcgccaggtcgagagtagtggcaattgttgagacgtcgacttcttttgaagcattccgtaaaaaaaataaaattgaaattcgtctactattgcttaaaactttatagattttagctgcttcattaactagatttgtatctaattgtgtcattatttaaaacctcattgacaatatatcaaaaatggaatattatactttctgcaataagtataccaaattcgatatatttatggagaaaaaatatgaaggataaatcatcactacgttacttttgggtaactttattaaatattattattacaattgcggaatttatcggtggagccgtttcaggctcacttgctctgctttcggatgccgtacataatttaagcgatgttggatcaattattttggcctttgtggccaatttaattgctaaaagaaagcgaaataacagcaagacttttggctatgatcgagcggaaatactagcagcttttactaatgggataattttaatagtaatcagtatttatttatttatcgaaggaattcaacgatttagtcatcctgaaccaattaaaggaaaaatcatgttaattgtttctttaattgggttagctgctaatttaatttcaatgctagtagtcatgaaggaagctaagacgagtcttaatgcaaaagctacatttttaaatatgctttcagatgcaataactagtgtagcagttgttattggagcgattgtgatttcaatttggaaaatttactgggtcgatccagtcttaacgatagcagcctctgtctttttacttaaggaagcttatgaagttactattaaagctgctaatattttaatggaaacgaatcctagcattgatttaaataagataaatgaattagttttatcttgtccacatgtgaataacattcaccatgtgcatgtttggcaatattcagacaatgtgacgatgttagatgcacatattaatgtggataaaaatttagacgctgtgcagttagaaaagatatacacagaaattgctagaaaattaaagccgcttggaattaaccatgtgacacttcaagctgaatgtacacgtggacttagcgataaaatgatttttgatgataaagaagattagttaatctggttttgctgctatttggtaaaataggggcaaagccttttattttaaggagaaaaaaatgagattcgatactaatgatctaaaagaaaatctaaaaaattatcaaaaaaaagctacagaccagtttaaggattttgctgaaaatgattggcctgatattaaagaccacttaactgaaaaaggacaacaggctggagattttttgaaacaaaatggtggaaaagtttatcaaaattctgttaatgcttttaaaaaagcagttcgaaacttagaccaaaaagtaaatggtacaagtgtacataaggacaataaataataatgaaggtaaatatttgggtcgcagtcatagttttatttattggattatgggatttatatacggcatataatcgttatcaaaaacataaagtaacagcgaaagtaattcaaaatgatcctactaatggaacaaaaaaattgcttactggtattccatctgatattaaagctgatatcatttcctttacaatcttaggtgtcgtttttactattaccggaattattttgttttttatggtttaaatggggtaggtgaaaagaaagttggccaaattagttttggttagacatggtgaaagtgtagctaatcgtgacaatgtttatacgggctggaatgatgtacctttaagtaaaaaagggattgcgcaggcaaaaaatgcaggccttaaggtagaaaaaatagctgaatttgcaccaacgcatatccatacttctgtcttatcgcgtgcaattatgacggctaatattattgcagatgtgtgcagctttttatatttaccgatcactaagacttggcgtttaaacgagcgtcactatggagcacttcgcggtattaataaggatgtttcaaagaaaatttttggtactaatcaagtcttagaatggagacgtggttttgatagtgtgcctcctttattaacgcagcccgtccaagatcgtagatatcaaaagtatgatatgcgtttaatgcctcagggagaaagtttacatcaaactcaagaaagactaatgccttatttttgggatcatattgcacctgaattaatggcaggtcatgatcaattggttgtagcccatggctcaagtttacgtgccttgattaaaaaaattgaagatatcagtaatgaggatattgtaaaagtagaagtgcccaatgcggagccaattgtttatacttttgatactgatttgcatattgtaaagaaagaaattctacattgattgagtagccaactggtctactcttttttaatagtttgtataggtatttttatggtaaaattttttacgagtatatttgaacaaattcttgtagagtaggagaaaataatgcgtaaaatatttttactaagaggagcacctggatctggaaaatcttcctttattgctcgtcaccacttgcagccttacgctatttctcgtgatgaaattaggctgctattagctgatttgacggtttattatgaggaaagcacagatcacctgcatcaagttattccacgccacgttactgtacgtacagagcaaatggttgataatttggtacagcataagatggcttatggagaaactatcattgtcgatggaactcatattacgccagataaaattgaacattttcgtccatgggttgaaaagtatcgctatgaattatttgtagtcgatttaatgcaaaataacactttagaaagcttactgcagcgtaatcaggttagaatgcactatgattgggtgaaacctgacgtaattaaaatgatgtatgagcaatataaagctcatccggaagttccatcttgggcttattcaattttgccgaatggaatggaacgggccttaagtcaaaaagaaaagaatttagatcattattcacatgtgatttgtgtaccagataaggtaagaccagaagatttcccacatgtgcatatttccaacttttacttttcttttaatgatgaatttactaagaaatacggaacatatagaaacgttataactttaggtaaaactagagaagaagtaatcgaacaatttaggcttccatattttgtatttaaattccatcataagcactttttaatttctgcatatccaattcgaaatgaaatgttagatcctattcgaaaagtaaagggagtttggtcttattcaactggactatataatattgctgattttgtaaaagaatttccagagaacgaacaccagcatgttcatcaatttaatttaagcaaaattgatcccacccgtttgttacatatttggtagtaaaaaatgagaaggtttttgccttctcatttttgtttggaaaagtttattgttttttcaataactgagattaggtcctaatacattagataaagtataaatttaaggaaggaatatcaaaaaaccatataggtaaactgttgaaaaataacaataataagacatcatttgcgttattatattgaaaattaggtataattgaaacgatgagagagattcagaaaaaaggatagggatgggtatgttttttaataagaaagataacgatagtaaacaacggttcggcattagaaaattaactataggggcctgttccgtattattgtctacattaatcttaggaataggaactcaagagcaaaattcaaaagctcaggctgctactacagaaacttctaacactgccagttcgacagacttagtagataatcatcaaaataaaaatacttacctaagttctagtgaagtaaatgaaacagctactaaagttaatgagaaagaaacttctgctggtaatgagcaacaagactctcaatctgcagtagctcaagacaagcaaagtggggaaaaggttgcagatgtagttactaataatcggtctacagttgaagataaaagttctaataatgcagaatcttcggaaatcactgataacactaagaatacggtaaattctgatagggcagaagttacaaataaagaagctaatacacaaactgattctaaaaaagttacgcaaaagacgtcaggtcaggctgttaatgatgtaaacaaaaatgtagctgaaaccactactgacactaagaatacaaaagtttccagctatactagtaatttagacttggaaaatattcaagaaagtcttgaacagcaagctaaggaaaataatggaaaagcattagatgctaaatcagttacatctttacttagaagttcggatgcagctaatttccaagttttggcagcattaacagaaaatatcgctgaggctgataaaattaaagccaacgcagcagtgacaattccaagtactgacggacgttatactttatatatttcaagaaatacgtggggaaatactacagatggtaatcaaccaactaaggttttactttcaggaaatgttcttagtggtgatactgtaactatttcaatcccaagctatggtattgtcggtgtcaattcgccaactatcgatgctaactatgggagtgcttctctaaaggatatgggtaatgataaggtagttatctataacttcaccacttctggggttattaatccgatcgttacgattcccgctgacaatggatatggtgctaaacccacgccaatgcaaattactcagcctacggttaaggatattacttggacaattaatggagtagaacaaacatcagctgaatttcatatcgatgttaaccctgtatggaatccaaagttttctttaagtaagcctaacccaaattctactgatcaaaatgcattaaaaaagatgattcctaactatgaatctatctatcaactcgcaattaatgaaacgaacggggttgctcctggacaagattatcaaaatagtcttccttatccttcctcaaaaattaatagtgccgttaattatggcaccgtaattacaattccaatgcctaaagggtatgtgctagatgaatctgctacaatgcaattcaataattttggggataaaactaccattacccaggacggtaataacattattattaccgtaccaaaaggttccggtacgcaaaactggaatagtgggggaccctaccaactagtgggttcttataatattccaatgcccaatacagctactacttatacggctgacgctccgattacgattgtgcaaaagcttaataatgacgggagtcgaacgaagacttggactggtccaacagtaagtcaagatttttatggtgcaaatgatcaaattccactaggccaaatgccactttatgctaaagctgcttataatggtaatcagcttttaaataatggtcataaacaaattgttgcttactttggtattactaatgaatcaattgcttcatacaacgattacagtagtaatcttacttttaattttgatgagggactaggtgtaactgaactaaaaacacctactattcctggtacaagtaactataagtacacaattacttacgcagatggtacaacgagtgaaggtcaagtaaatgctggtaacactattacgggaactggagtaattactaacattgtggttagccctgataactttgaaagagatcaaagtacagctgttgatttgccaactaataagtttgcaaatcaaactactcagtcagtgaatgcttttgaagcatatggggctgttccagatacagttaaaccaggcacacaattagttgctaacctgacctttactgggacaatccaacagggaaatataacaaaatatttgaccagcaaaattcaagttgatcaaacagttgtttcatcagctgatttaacttcaagctcaggtatatttggctatcaaagcaacacagcaacagggcaatctaatgtggggtatctttctgtctacgctggcggaggacaaaccaacaatatttatgaaccaattttttactatgttttaccggagtggttctcagtttatgatttttcaaccgactataccaagctacctgattttgtccctaatactaataatggtgttattggtacgccaaagttgtcagtatttactgttccaacagaaatttcgggactctctcgtcaagttgtaaaaattgattactctggtactggctataactttcttgctggccagggtgctaacaatcaaattcaccttaatacgttacctgacggaactaatggtacatatcaagggataatctatattgttagtccaacgacaaaattaacgaacactgcttataatcctaataacacaagcaattttgctcctagtggtattacttttaatccagattgggtacagggaaacacttctaacttgtactatgtcggagctaatggttttaccattaatcaagtcggtggtgctaatactgctagtgttgctcaaggtaatcaaaatgatatattggttgattctggtgtctctgatctttatggctctaatgaaatggaatatgctgttcgtttaattaatggatcaggtactaaattaactaatgttgttgcgatggtgaacttaccacaagcttcagatactagttttgctttccagttaaatggtagaccagtttataatggtgataagacagggtacactttcttgtattctacggaattaggtaatcttaagagtaataacgatcctgatggtactaagcccgatgagaccggatatgttccagcagatcaagtaactgattggtctaagattaagtcaattattattaaaacttcatccttaagtaataatgaccgttccgatcgtttgattttcacaggaatagatcctaacttggtaaatgatgcgggtaagacgggatatattagtactggtttctattccgatactactaagccatttatcagcagtttggcagtttataattcaagtactgtagctaacaaagttaagccagctaatattactattacaggtgaggctaatattaattttaagcttcagtatacagatgaaaatgggcagttgcagacgattaatcttcctgatttaagtactagttataatttggctcaaaacaatacaatgttgactgagcaagaagctatcgaattagctaataaaaatgcagcatcgtctattcctgcaaactatgaaattaagtcagcgactttgcaatctggtggtaaaacttggcaaactgatgcgccggaaggaactcctgtctttggtgggcaagtacaatatttctataataatgctactgtcctcttacaagctgtgccaatccaacgtacacttacttaccaagtaattgatgaaaatgatccatcaaacccagtaactatccagccgaacactgatttattaaacaatggccaagcaattactggtaatcaaggaagtaatgttccacctgatgcaaccactgcatatgatgcagttaagaatgctttagaagctaagggctatgttattagttcaaagagtagtactgtaccaacaatttttggtccggataatactgcattgacaatttatgtaactcataagactataaatgtaagtacaccagatcaatggccaagtacaagtactgatgcagataaggtttcactgtctaaaacaattactcgaactatcacagttgaaggcttaccaacagctgttgaaggtactacccaaacagtaacattcactagaacagcagttgttgatgaagtaacaggtaaagtaataggttatgtagatccaagtgatactagccaaactattactgatggcgataatgcatggactagtgttaataatacttggtcagcatttacccctaaaaatattcccttaggttattcaatcaaatcaattaccgatgccaatggtaactatgcgaatgttacgagcacagatggaaaactaacaggtgtagcacaaactactgttgcaactaatgaaagtgatgttacagtaacgattacttatcaaggtaaccaagtaagtaatacgattacttttattgatactgacgataacaataaacaagttggagaaactattaccattagtggtcgtgttggagaaaccgataacaatcttaatttaactgttccagaaggctatgaactggctaatggagcaagcttaccaacaagttatacttttgaagcaactaacactccaattactattccacttgttcataaacataagactgttggacctaatgacacgtggccaagtacaagtactaatgcagataaagttccactttctgaaacgattactcgcaccattactgtgtcgggacttcctacaaaggttccatctgttgaacaaaatgttaactttactagaacggcaatcgttgatgaagtaacaggtaaagtaattggctatgtagatccaagtgatagtactgagacaattacaaatggtaatgctgcatggacaagtgataatccgacttggagtagctggactaactcaactgttccagaaggctactatattgaaagtgcaaaagttggtaatactgactatcctacagtaataactaatgcaaatggaattattactggattaaatagtgtcgatgtgactccaaagatgagttcgataaccgttaatgtggtttacaacaaggtcaatcttgatttaacgattaaccatgacactattactaatacctacaatggcagtgaacaaccagtttctcctgatataattagtgaaattactcatactgttgtttcatcaaataatgatgtatctattcaaaatattgctcaagctattcaagatgctaacttgacgtcaaatgattattcatacacagatagccaaggtaatgttttaactggcactccaactaacgctggtaattaccgcattattttgaaccaaaatggtttgaataaattaaataaagtagctggcggcttaacaattaactatgatccaagtaaatcatacgttaactacactattgaaaaagcagaagcaagtgctgagctagaaggaaataattctaagcagtatgatggtcaaagtgtaactaatgttgaagttactaaagatggtaagatcaaagttactgcgaatgttccgggcactactcaaagtgcatatcaacttcaagcgggtgactatgactggtatagcgcagatggttcaactagattaagtagtgcaccaactaatgttggaaattacatgattaagttaaacagtacgggaattgccaacattaaagctcattatggcaatagcgacaacattaattggactgatgatgcaattacaggcagtgcaacttatgaaattactaaagctgcagccactatttcactaactcctgataagaacaagcaaacaagtagttggactggaagtgaaatttctataaatccagctgattttgtaccaactcttaccactgataatggtgtgacactcactgttcctgctggtactttagcagttggtgactacacagttactccttcaccagttgcaccaggaacttaccaagtttcattgactaactcaggtattgaaaagattaaaaaggcgatttcaactagtgaaaactatgtttggaataatactggtaatggagtgttagaaattgttaatgctaaagcggactatcaaatgtcaggcagtggtgaaactacttatactggttctgcggtagaattaccaatggatcaacttaaggctgcaatttcttcatctaatacagttagtggtcaagatttagttatccctgagcttgatgttaatgactttacttggtctagcggtactgccccaacgaatgtaggtaattacactatcaagttgagtgaaactggtattaataagattgctgcagcaaatccgaattatgccttaactttaggtacgaatgcctttacttacaagattaatgcggctaaagcaagtgcaactgtaagtggtgagaatagtcgaacatacaatggtaaagctatttcaattaatgatatctataatggtggaactatctctgttaaaattactggacttgacgatcaagaatttacttacaccttgcaaactggtgattacacttggaatgtatctgatccaacaaatgtgggtacttacactttaactttgaatagtactggaattggtcacttacaagatctcttgaacgataagtacggtaacggcaatgtaactattgctaacagccaagttactggaagtgcaaaatatactattgaaaaggctaacgccaatgtaactttatcaggtaatcaagatgaaacttatactgctgaagaattcaccaatagcaacattaaggttagtgactacaaggtgactttgagtaacggattagaatacaagctagttgatggagacttagaattcattccaaatcaaaatccaacaaatgtcggtacttatactgttcaattgtctgatcaaggtaagaagaatattgctgccgttcaaggtaaaaactatgaatatagctttaatgatactggagtaggtagtttcaatattactaaagccacaccaagtgcattatttactggtcaaggggaaaagacttacgatggtacaccaattagtgggtatgtaccaaaggtgacgattacagctccgggcaaaaatgatgtaactttaattgctggcactgattatatttggactaagaatggccaaacatttactactgctccaagtgatgcaggaaattatactgtttcattaactttagacggaattggtaagatcaaagcagtaaacgctgcaaatcttgattggtcaaatgtaataattagtgaaaatgcaaggtacactatcactaaggctcaagctacagttaactttgctcaaccagctagtcaaacagttgaatatgggaagaatgattttgatgtaaataacttcaaaccaagtattttcacaaataatcatgtaactgttaatgtcccagagggggtgagcctttctgcacaagctggcgactttgagtttactaatgccaatggaaatacaacaactaccgttccaactgggctaggaacttacactgttactttaagtgaagctggctttaagaaacttcaatcacagactaataattatgactggataaataatgcaaaaggtacttacatagtaactaaggcaactgatgtgtctgtaaccttaatcggtaatcaagaagtaatttataccggtaatacatttacaaatagtgatattaatgttaacgactatcaagtaactcttgaaaatggtcaaacttacaagttagttgctggcgatttggaatttggtccgagtcaagatccaactaatgcaggagcttacaaggtacaattgtctgcacaaggtaaggaaaatattgctaaggtggattcaactcattatagttacaactttgataatgctggtactggtaattttgaaattcaaaaagctactccaagcattgaatttaaggccaatgctgaaaagatatttgatggcacatcaatagctcttggggactacaagactcagccaagtgtcaccataactgcaccaggtaatccaactattactctggaagcaggcgattatgtttggataaaagatggtgttacttatacaactgcgccaagcaatgttggtagctacactatccaattatctgaatcaggtaagaataagatcttgcaaaatagtaataatacagaaaatcttgattgggctaatgcaaagattagtggtcaaggttcatatataattactgaggctaatgctacagcaaatctttcgggtaattcatctaaaacatatgatggtaatccagtaactacaactgaggttaatagtaaagatggtacagttgaagtaactattaccattccaaacagtagtgaaactgtaacttataagttacaagacggcgactacacttggaatacgctaaatggggatgctccaactgatgcaggtgactatacatttaagctaagcccagaggctcttactaacttgcaaagtgcaattgatggtaaatggggtaaaggtaacgttaagataacagatagcgatcttaacggagaagctactttcacaattaataaggctgatatcactatttcaggaaacagtagtcaaacagggacgtacaccggagatccacaagtagtagatccaagtaatttcccaattacgttaaccccagaaggtgatggtccagttccaacaattccagctggtactttaacaagtagtgattttatagttaaagataaagatggaaagactgtagatccaaccgatgttggagactacacagtttacttaactccagaaggtgttgagaaacttaagaagctcaatccaaactacaactggccaacaactgaagaagaagttggtaagttagtaattaaagctgctcaagcaagtgcaatagtaagcggtgaaaatagtcgtgtctacaatggagaagctattagtaccgctgatctttaccaaggtggagacattaatgttacgatcgttggaattaatgatgataagattacttataccctaaaagctggagattacgattggaatgtatctgatccaactaatgttggtacttatattttgactttgaatagtactggaataagccacttgcaagaaattcttactacaaaatatggtgctggaaacgtaacccttgcaaatactgcagtaagtggcagtgctaagttcacaattactccagcttcaatcattatttcagggaacggcagtcaaacaggaacatacacaggaaatccacaagtagtagatctaagtaatttcccaattacgttaaccccagaaggtgatggtccagttccaacaattccagctggtactttaacaagtagtgattttatagttaaagataaagatggaaagactgtagatccaaccgatgttggagactacacagtttacttaactccagaaggtgttgagaaacttaagaagctcaatccaaactacaactggccaaccacagagcaaaatgttggtactttaactattattccagctgttatggatataactttatcaggtaatggttctaaagtttctgatgggcaaccagcaaaagttgagctttcaacattggtagataacttaactggtaacaatcttaataaagatggtttaacactggatgactttagctggaatactccagatggcaacgctccaagggaagtgggtaactacacgattactttaaacgaaaacgggttgaagaaacttcaagctgataatttaaactacactgttaatgtaagtggtgaatttaagtacactattactgctgctcatcaaaagattgagtatgttgatggtaacggcaatgtcattaagactatcgaaaatattggtacggctttatctaactatggtgataaagttgactttaatgtaaaacaaaatgttccaaaagattacaagttggtagattctaatgtctcaacccaaatcactattgaaaatggtgtaactaaatttttagtcgaacctaatattgtaacaacaactgatactaagacagtaacgagaacaattattgttgaaaacccagatggaagtgagaacaaagttgtacaaactgtaaccttcactcgtcctaagtacactgatccagtaaatggtgaggtaacttacggagaatgggataagagttcaggtaactggaataagtacagtgcaccagagattccaggctacacttcaaatgaagtaccagaagaatcagtaactccagctactgcagacaagacagtaactgtgaagtacagtaagaatccagcaattgaaacaactgatactaagacggtaacgagaacaattattgttgaaaacccagatggaagtgagaacaaagttgtacaaactgtaaccttcactcgtcctaagtacactgatccagtaaatggtgaggtaacttacggagaatgggataagagttcaggtaactggaacaagtacagtgcaccagagattccaggctacacttcaaatgaagtaccagaagaatcagtaactccagctactgagaatcaaattgtaaggattgcttatagcaaactacaagaaccagaaaatcctattactccaactaagaatgagaataataagaaatctgagaaagtatcaccagtaaaatcacaagttttaactaataagacaagtaaaataaagactgtgaatactgtacaaagaactataagaaaacaagtaccaagaagccaggttaagaaaaataatcaaacattgcctcaaacaggtgctcacaaggatatgctcgccattatatctggagcatttgcagtaggaattggattatttggcttaagtactaatcgaaaaaagaaaaaataaaatttgaataatctggatgatttccagaaataataaacgctgttaagtcaaggtttaataaaaacaagatttagcagcgtttttgtttagtaactatgttttagattgacatactgttgggaattaagtagctaaaagtagctgcttaattcctttttattgtattagttaaagttaagtagttatttttaaacaactaatttaggaatgactaaaaaatcctgttggtgaaatagggtaactatttaccaacaggaaagaatatatttattttactagaaattagctttgattctctatagctgattcattccgttcatccgcatcaactactgtttttgatacttgctgatcaggtttatatgggcgcttaatcggcatccccattggattctgtcctttagacatcaatacagtaggaatatttgatgtaactttttcaggctttggtaatccttcaatttcccaagtaaagggagcaaattcgttttttggatttacccaatttggatgctttttagaaagaaggtaaagtcctaaacaggtaagtaatacaactgcaactaaaactgcaataacaattatataagttactggagatccgacttctgccttaacttgtgctggtggataaaaggcaagaacaataccgaaaattgatgaaatgaggccaacaccggcaataatccaagctcctaccttaccaccaggtactttaaatgaacgaggacggttaggttgttggtaacgtaaacgtaagaatgcgacaaacattagaatgtagtagaaaagatatagaacagtgacacactgtgttagtaaaattacaaatccttctacatttggaattaatttgaatagatatgcaataatagtcattccagccatttggacataaactagtcgagcaggcattccatgcttgtttttcttttgtaaccattttggtaaaaagccactaccaccagcttgggcaagcataactgatggagctgctagttcagtcacagtagaagcaactaaattgaaaagtccgacccacattagaactagatacaaccaaggaaaggcaaaggtctcaccaagaactttaaataccgtaactaatgaatataaaacattaatttgtttttctggaacgatcattgcgatgattacagtacctactacgaagattaagaatactaagatcaaagtaataaaaattgaagatacaaaatctttttcagggtgccgtaatcgtttaatgaaggcagcattttcatcaattccagtataagagaagaatacaccagctgcgagggctaaagtactcattccattccattttggaattaattgttttggtgccattgaaatagtgggggtatgtccctggcacaaccaaacgattgttaggataatcattactgctaatgggataagtgttccaattaagacaccatattttgtaatagtggtaaaagttttaacacctttattagcaatgatagccataatccaatataaaataatccatccagtcatgattaaaacaacgtgagtaggattttgagcgaaggcaactgccttgttatacataggcgtgtagaacaaaatggttgcggtggaactcggcatccccatcccgaagttaatcataacttgaaaccataaaatcaacagacaagttaatgcccatccttttcctaaaccttcaccgacccagcggaaaataccgccacggttgctccagccagaggctagctctgcagctactaaggcggtaggaatgaagaagcaaatagcaccgatggcaaaataggtaactgacgataaaccataaaaggcttcttgaacatcattacctaaaccagcgataattgccacgttcattagagttagggtccatatggagataaaggcttgctttttggcagatcctgctttatgagaattctccatttttctctctcctttaaatatatacaataaacaaaatcaatatgttatttattaatctgctcatgtgtatactagtctcatgtttcacaaactacaaataaaaagaattaaatataagagttaaaaacctttataataagctattgtttatctatagccagcctttatttattatattgtgaattaagttactaattatagtgatgtgactatagtaatataatcgtgaaaagaatggctatctacttaggcaagaagaataaaattataaattagtaaaattaaatcaattcttaaaaataacgaattatattatttcattttttatatatttctacttaagtgcttttgattataatgtagtatatagggtatagacttgaaaaatataacattaaatataaaaggatatgtgtagaagaaatatatctttgaaagagtagtattgctcaattcacttatcgaggagaagttcatttggaaaagaaaaatcttttaaatgtaataaagaaagtaagctttagtctattcatagtaataatttatgtaatgggattatacattcctcttccttttgcagaagggactaaacagtatatggaagctgtaaaaaatactcctatttcaattttaggagcatttagtggggccaattttacacggatatctattttttcaatcggtctgaatccattaatgttttcgatgttaattattcagctgctaagttttactcattcctttggttttgatgccttgtcaccgaaacaagtgcagtacttgatgcaatttttaactatgattatcactatcattcaagcagcactattagtctttgcttttacaaatcgacggaatggtttagaagattttgaaatgatcttgatattgagtgctgggtcttgtttagtagtttggctttgttaccgcaatatgaaatatggggttggagcaagtgcaccagttattttaacaagcattcttaatggtgccattcccaatataattagtaatgtaaaacttcttttaaccatgaaatatgcatggatttggttagcagctttagctatttttattttgttactaataaaattttggcttgcgtttactaaagcctactatcctttaaaagtagttaatcctagtcttcctgcctctagtaatttgatgacagtgccgttaggattaaacatggctgccatgatgatgtatatggtaggaatggctattttgacccttcctttaatggtgggaagatactttagttcttcatctttgatcaataattgggtatttcaagcttctttttctgcagtaatgggaatattgattttttatttcttcacttttgtaaatttcgatcctaaagaacaagccaagagttttcgaaataatcactactatattccaaatattgctcctggacgtcctacacaacgatatttaaaccgtctaatatggattattgcctttccgggagccgttttaaatgcatttcaacttgtttttggtttatatgggggtaattttttaggtaattatgctggctttgctattattccaatgaatgttgttatgattacaatgtttatgggaggaattaaagatcaaattgatactattttgttcccatatcgttatgatcgtttattaaaggataactaataatgaaatattttattcctgcatggcataaacaatacgatgactggtcaattaatattccaagtattgaaaactatgacgcagcagaatacatgactgttttaaaaaagtttgacgaagaaattggtctgataattacagactatcagtctcaattgttgagtaaattaaatcaaattgcctttttccctaataccctattttctgtatatgattttttacaaggagttcatggatttgaaaataaggttttagaattagaagattttaactggcctaaaaatgcaatttttgattatggtccttttagaaccttaattgttttagaaaataaactatatgcaacagttttctatgatattgatgggcatattttaaggatctcttatcctgaaaatgacgagcataaagcatttactttgggtatagatagtcgtggttttatctctaatcaagatgatgaggaaaaaactatctactttgatccatacggtaattggcgttttaaaaaggacaaaaccaccgacaaaatcacggttaatccagaaatgcatttttgtaaaagaagagaatatgaaaatattacagatttggttgatgagattttaagtcgatacttaaaggtcaatgctaagaataatgatgaaataattgtaacggtagatgatgagagtagttttaataatgaaatcattgagccatataaacctttatatataatcaatagacaccatccttatagtaaaaaaataggtagcctagctagggcaaaagtaattgtaagtagcaatgaaattaaacaaaatctagaaaaaaattatagagaacagttcgatatttcagttattcccgtctttaattcggaatttcgtcttggtcatagtcaaagacaaaatgtacaggagattggcttctttgcggaaaatgcaaatgacgaaaatattcatcaaattattcaaaagctgtgtaactacatcttaaaaaatccagataattacagcttgaaaatatttacatacaatttttggaaagctgatcatgtgaataaaattcttgagcaaataaaagaagaaaacaaaaacagttttattctcggaaagtcagaacaagcagaaaatgctccaattgatggacttgatgatgaagtgagtttaccagaacttgatgttgcgcatacccgtttaactaatatttcagatgtattaagtaatttggataaaatgagacttttaataaattggggaaaagcggatgaattaatgcaaatatcaggtgtaagtattggaattccacaagtgcaaaacttttcttcggtcactgttgtggataataaaaatggacgaattataaagaaaataagtgagcttttacctgtagttgatgagtatttaactaatttaaatagttggaatcagacagtagtatataacgtacaattaatgaaccagtattccgaagaaaacatcattgagaaatggaaagaagtatttaaagagaggaaagcggagtagaatgcgagttttgcaactaggaaatgataactgggagaaaaaatatacaatcccagaagatatggaatggcattttaacgacttttcttttgaggaaaaaaaggctacgaagaaaaaggggataaaaagttatgatgtaattttagttactggtaaaactaacttaactaatgaccagttgaagaagttaaagcaattgatatccccatatcatgttttatacagttctaatttaaatacagaattggatgatcatgaaaaatattttttgaaaagtattgctgctcaaaaaataaaagaagaaccccagtacttaattgatagacttccaattcgttacttctctggacaatctggattaaggatttttccaagtcaactgaaattaaatgagcacgtggttaagatttatgagtttgaagaacagggtcatcttaaagtaaatctagatacccacaatgaatgggtaaatttaggtacttataaaagtggggtctttatcgatcctgataagcagatcaatttttggctttcattaaagaatttcaattttcaagttagactgagaatttttattcaacaacctggtacagatggagatgtcaaagaacaaagagtaatcgacttaagctcttttaataaagatgaatatttttctcaaattgaagcatctgaacactatcggactgcaaccctaaatctagaagttaaggggagcggcgacttaatcattggcgtgcttcattcacgttggggccgagatggggccggaaatttcattgccggtgggcaaagaatagttaatcctcagactagggatgatattgcctattactttaatcctggcgacctgaagcccccattaaatgtatatttttcaggtgcgcgtgaagcagaaggttttgaggcatatttcttgtttaaagggttaaaagcaccgatgcttttatttactgatatgcgattaaatattggtcaattttatgacgataaggataatttttttgagcaagaaattattaaaacaattaagtcaaaattgaatgaattggggtttgatgaatcgcaactactagtaaatggaatttcaatgggaacatatcctgcgataaaatatggagctaaaatgagtgctcatgcaattaatgttgcaaaacccttggtaaatttgggctatattgcttcaaggactgccttagatcgtcccgacgaatttgaaactatgttcgatattgataaagggatcggtccagctaccgatagagatgacttgaaaaaaattgatgagaatttttggaaagaatttgataagcaagatctttcaaaaacacgcttttttgctggttatatgattaatgatgactatgacgataaagcagtaaaagagttaaaagagtctcctgctgtaaagcaagcagcccagttttctgctaaaggatttcccggacgacataatgatgatccacaagttaactactggtttattgatcgtttaaatgaactattaagagaagattttggtcgagataatgaaaaacgtaattaatcaagtttattgggatagaatgtcagagacatatttatatggaacggcatttaagaaaaacgctaaaaatgaagtcacttttaagaataaattgatgccttcaggaaaaactcttattagctggtcatcaatagcaaattatcaggcagcaaaagaagtccctagtttaccacttcttctgaatggacaagaatatttattaaaaattagtgcaaagattaagccggaaaatagtgcaatttttggaatacatttttttgatattcaggggaatgaaattgataaagttattttcactgatttagaacacaagtttaaatatccacctcgagcagtgaaatacactattgaaataattagtggtggagtagaagagattaattttaaaaaaattcaaatctctcctttggatttagaagaagaagtttttaatgacttttatcctcatcctatttatttaaataaaaattcccaaaaagaagggcttattctacttgatgattctaaacgagctagaattattgctccatttaagattaagagttatgtgggagccaatttaactattggatatctgagttggcaaaataaacaacatggtcttgaactgttgaaagattatattaatgaacataaagataaagaattagtcatctttagcagcagtgctgatatagatgaatccttagcaaattctaacaccttaaactgtatggtagtgtattcgaaggcttttgtagatgaaggatatcataatttgcaggaaacatatatttcaaaaaattatcgagaacctgatcaagttcgaatggtaaaagaagctattaattattttaaggaatgatgcaatgctaacagataggttaagactaaaaaaagccaggaaattattaaataaaattaataaattaggtcctaaaatgcaggcaatgagtgatgaaaaactgcaaggacaaactgctatttttaaaaagcaacttaaagaaggtaaaagtttagatgatattttaccagaagcttatgccactgtaagggaagcagataaaagaattttggggatgttcccctatgatgtacaggttttaggggcaattgtattacataatggctccattgctgaaatgaaaactggggaaggtaaaactttagttgcgacaatggctctttatctaaatgctttagaaggtaaaggcgcaatgttagtgactccaaatggttatcttgcatctcgtgataaaaaagagttagctccagtttatgagtggctaggtttaagtgttagcttagcttttgcagaagagaaagatagtaaaaagaaaataactgctaaaactaaaagaaaatggtataactccgatattgtatatactactgcttcttctttagcttttgattatttgtttaataatcttgccagctccaaagaaaatcaatatttacgcccatttaattatgttattgtcgatgaagtggatgaggttttattagatgaagcacagactccattcgtggtctcctctagtcctaatgttcaatcaaatctatatcatttggcagatcagtttgtaagactattagatcccgaggtggactatgtatttaaaaaggatgatcaattattttggttaacagcccacggtattgaaaaagctgagcaattttttaaactagatagcttattttctaatgagagcaggagtgtttatcgccatattattttagcgatgggtgcgcacttaactatgagacgaggacatgactacttagttgtaaaaggcgaagtggtcttgttagatgaagatagcggtagattaaaacgtggagttcaggtaagtacaggaattcaccaggctgttgaagctaaagaaaaggttgagttgactaaaattcagaaaacagcagcttcaataacatttccagctttatttgcattgtttaataaagtaagtggaatgagtggaactgctaaagttaatgaagaagagtttttacagacctataatttaaaagtggtaactatccctacaagagtgccggtaattagaaaagattatcgcccacttattttcttaactacaatagataaattaatgacagctgtagatgatgtagtagaaatgcataaaactggtcggcctgtgttacttgttgctggttctgtagaaaattcagaaattatttcagaactattactcaatattggtattcctcataatgttttaaatgcctataatgcagcctatgaagcgcaaattattaaaaatgcaggtcaaaaaaatgctgtaactattgcaacaaatatggctggtagaggaactgatattaagctaggacccggagttaaggaactaggtggcttagcagtaattggaactgaaatgttacctaaaagggtggaattgcagctagcggggcgtgctggcagacaaggagatccaggtagcagccaatttctgatttccttagaggattcatttatttcttctaataatactcctcgtcagaagaagtattaccgcaaattaatgaagaagaagtcaaagggaaaggatattactcttctctcaggtccgcgaattcgatttagtttgctcatgctgagaacccgtaaagaagatcttaatgagttgatgagaagtcaaactaataagatggaaataattttatcgcttcaacggaagaatttttatactagaagagacaaaattatgaaaactgatgatttacaggaagatgtagatcggatcatcgataatgcactgaatctttatttagaaaaacaggatttatcaaataagagtgatttaaagtactttattaaccagcatgttacttatcaacaggttaatgtaccagataatttgaaaactaaaaaagcaattaaagactttttgaaagaattagcttacaagattcttgatgagaagaagcatgtattaattaacaaaaaacaagcaaatgatttttaccaacaagtgattatttcatcaatggatggaaattggattgatcaagtagatagaattgaaaaaataaagattaatgcacagcaatggggaagaagtggaagaccgcaagatcttctccaccaagaaaaggcttttgaagcgtataaagatttcttagataaaattaccttgtctacctttgataatcttttattaagcaagatttttacgaatgaaaaaggacaattagttgtagtatttaattagtaggggaaaattatgaccgtatataacataaatttaggaataggttgggctagctctggagtagaatacgctcaaaaatatcgtgatcaaagttttgataaagtgggaattgaacgaaaatttattttttcagatttaattttagggaataatatcggagatttaaccgccaatttgggttttgataatgacaatattatctggttatataacttctttactgatgtaaagagttcaacgtctaattattctttagatactctagaaaacgaactcaatttaaaaaaactaagtagtaatgtaaagactgttggaaaagaagtattttatcaattaaatgatggcttacagctagtagctcgactaagtgatgccgaaaaacgtaccattgatcaggttagctatgttaaaaataatactttacttaagagagacttttattcttacactaagtatgcctgtgagtattatttaggtgcagataaagataatcgggttacctttcgggaattctataatgaagatggcacaattgcttatacacaacatttaaatggtgatcaagaaacatttgaatttgcaaatggtgaagttatttatagtaaagatgacctttatctgaaaatgcttaaggaattgaactttactaaaaaagacgtaattattctagacagagaagatgaagataagaacttaattaatggtcaactagtttttgaaaaccatggaccagctaaattagtggtggtagttcatgctgatcattttgataagcactataccacagatcaaaatatcttatggaataatttttatgaatatcaattccaacatgcgaaatatgtcgatagctttattgtagctacaaatgaacaaaagaagattttaaaaaatcaatttaaaaaatactataatattgaaccgcgtattgattgtattccagtgggaagtttaaatgagttggagcaccctacacaaggaagaatgaagcactccttaattacagcttctcgcttagcaaaagaaaagcacattgattggattgtgaatgcagtagtagcagctaaaaatagtgtccctgatctttctttagatatctatggaactggcggtgaagcagggatgcttactaatttaattaatcaaaatcaagcacaagattatattcatattatgggacaaagagatttaacaaaagtctatcgaaactatcctgcttatattgccgcttcaacaagcgaaggctttggtctctcactgcttgaagctgtgggatctggattagcaatgatcggctttgatgttccttatggaaatcctacttttattgaaaacgagaaaaatggaatgcttttaccatataatgaagaatggactgactttagaaaagaagaagttttaacaaaagcaattatcgagatgtttactaagagtgatgtagacagctttaataaaaaatcatatcaaatagcagaaccttatttaactgcaaatgttgctaaacaatggaaaaaattagtggggggaattggtcaatgattaatttatttgaaaatttagacgtagaatcaaccgactttctaagatcacagctttttgctaatcttaaaattccttctgtggtaattaatgatgatggttttttaccaattgaggtagactctccctttaaattctattgcggatttggtgatgaaaatactcccctgtactttaaccgtctaaaggtgccagaatttcatcgaattgtagcaactgcaagtaagggagaagtctatgatctttatgaaaagagagcagatatttttttccttgctactgataatactagactaattaaagaagttcattggcttgataagaatggtaacttgagctggattgatcactataatcgtcagggaaagctatttgctaaaacttatgttaacaatggacagcaagttttaaagcggtactttaataaagatggaaaagaagttattacacaatatttagtttctggtgatatctttttacatgaagaaaataatgaaagatattttgctaatttagctcaatttgtgacttactatttaagaaaaaagaaataccagcttgatcatattttctataatactttgaatcaatctatgatggtaagtttaggccttcaaaatgatggtagtgatacgttgttttggcatgaaaagattactaacgatctaccaggtaatatgaagtatttaatggacaatagtaccagaactaagcatattgttttccaaaattatgtagattggcaaacgtggaagaataaattaccaaatgataaaaatgttgattttagatttttaggtatgatttatcctcatccaagaggaaacaaaatgcgtcctgaagcagttattttgactaactcagaccagattgaacatttagatgaagtagttcaagcaatgccaaatattcattttaatattgcggctattactgaaatgtcatctaagttattagctttcaaaaagtataacaatgttcgtttataccctaatgccacaactaaacaaattcaggaattgtatcaaactagtgatatttatctagatataaatcatggtaatgaaattttggatgcggttcgtggtgcttttgaacaaaatatgttaattctgggatttgaaaatactttgcacaattctcaatttattagttcagaaaatgtatttaagccgaatgaagttgataagatggcagataagatttcagatgctttatctgatacaaataatatgagagagcttattgatgagcaacgtttacttgctggggatgtaagtgttgaacagtataaagaggttatcggcgatttgagaaatgaataaagaaaagaaaaaatcgacgttagtggaacaacacgcgttgaagcgattagaaaaagtagaagagaaccagagaaaagcttatgaaaaaaagcagaatgattttccctggaaacaaataactatgggattactttttggaataattttacttttgatgttaatccaaatgatagttaaataaaagaaggctagtcttattgtgatttatactttttcaaacaaatagttaaaatataaattaaaaaatcagttcgtcagtattacggactgatttttttctgttcttttttagtttacccttgtcttttacttgttgaataataaaaaacgaataaagttatattatttttgcttttttattaataataaaattttataaataacaattaagaaaaaatattttctattttttctttgatttatcaacctttttcttttatttaattactaaagagttattatagagtatgtaataataacaattgaaatgcttctaataaataaaattaattgtaatattatagtaacgagtaggaaatgttatgaaagacaaaaaatttaagaagaatcaaaaaaataaatatgtcgatcctaatagtttaaaggaatcgggagacagttctaacccatatcttaaagaactagcagctttagcagcaattctgggaactggagctacaggggcagcaattttacctaatgatcgtgtatatgctgcacaaacttctgtagatgctaaatcacaaatagttggatcagtatctgaaagtacgcagactgacttgtcaaaaaagggaaacagtaaatctgatgaaaatggagtcagtactagtaattcagaagctaagagtatgtctacttctagttcaaaaagcttaaggatctctcggagcgcatctacctctttgagtcaatcgcaacagatttcacaatctatgtcattaagtaattcgcagagtctttcggagtctttaagttattctaaaagtaaactaaattcttcaagtaatactcaaaaaaagatatctaattctgagacgcacagtacttttaaatcttcgaagaataaaaaaataagtgaagaaaactctcttacttcaagctcaaatactaacagatctagtaataaaacaaatataagaaatttctattctagtgagacctcctctcttgatagaagtcaaggtccttttcaaagtaatactagtgaaataaatagcttaagtttgagcagtagacagcttataggtgagaattttcaaatccctgtagttattcaaaattctattaacaatagttctgataataaaacacaaactaataataaaaaactacagatagataaattgaatttaactggtgtttttaccaacctacttcaaattaatgatgaaaatgcagtagatgtaagcactagtgctgaatttcaaaatgctcttaataattcaactgtaaacgctattcgcttgacagctaacattgatttaggacagtcaagtatcggaagtattcgaattcctcctcgtaatctgacaattgatggtgctaatcatgaccttaacttaggcaataattgtatttggctcaataattctgcttcacctaagactccacgatattaagtctcttaatctagtatcgatgagcgagagcttgagtaattcagtaagcatgagtgaaagcttaagcaactcagtaagcatgagtgaaagtttgagcaactcggtatcaatgagtgggagcttgagcaactcagtaagtatgagcgagagtttaagtaactcagtaagcatgagtgaaagtttgagtaactcggtatccatgagtgaaagcttaagcaactcagtaagcatgagtgaaagtctaagcaactcagtatcaatgagtgggagcttgagcaactcagtaagtatgagcgagagtttaagtaactcagtaagcatgagtgaaagcttgagtaactcggtatcaatgagcgaaagcttatctaactcagtaagcatgagtgagagcttgagtaactcagtaagcatgagtgagagcttaagcaactcggtatccatgagtgaaagtctaagcaactcagtatcaatgagtgggagcttgagcaactcagtaagtatgagtgagagcttaagcaactcagtaagtatgagtgaaagcttgagtaactcagtatcaatgagcgaaagcttatctaactcagtaagtatgagcgagagcttaagtaattcagtaagcatgagtgaaagcttgagtaactcggtatcaatgagcgaaagcatgagcaactcagtaagcatgagcgagagcttgagcaactcagtaagtatgagtgaaagcttaagtaactcagtaagtatgaatgaaagcttgagtaactcagtatcaatgagtgagagtttgagtaactcagtgtcaatgagcgaaagcatgagtaactcagtaagtatgagcgaaagcttgagtaactcagtaagtatgagtgaaagcttaagtaactcggtatccatgagtgagagtttgagtaactcggtatccatgagtgaaagtctaagcaactcagtgtcaatgagcgaaagcttatctaactcagtaagtatgagtgagagcttaagcaactcagtaagtatgagtgaaagcttgagtaactcagtatcaatgagtgaaagtttaagcaactcggtatcaatgagtgagagcttaagccattcagtaagcatgagtgaaagtctaagtaactcggtatccatgagtgaaagtttgagtaactcagtaagtatgagcgaaagcttaagcaactcagtatcaatgagtgagagtttgagcaactcagtaagcatgagcgaaagcttaagcaactcagtatcgatgagcgagagcttgagtaactcggtatcaatgagtgaaagcttaagcaactcagtatcaatgagcgagagcttgagtaactcggtatcaatgagtgaaagcttaagcaactcagtaagtatgagcgaaagtctgagtaagtcggtatcaatgagtgaaagtatgagtaactcagtatcgatgagcgaaagcttaagtaactcagtaagcatgagtgagagtttgagcaactcagtatcaatgaataagagtcaatctagatcaacaagtacgacaacctcaacgaacagtactaacaataatggctctaaatcaacgccaaataacagtggtactaaatctacttctactgatacgcttcagccacaacataaaaatgctgaatctgtagataaggcagctaagaaagatcaccgtagaggtaaattgcctcaaactggtgcagaatcaaattcaagcttcttgggattaatgatcgctgctttaggtggattgcttggcttcagacgtaagaaacgtaaagatgaagataaagattaatagatcttaaatataataaataaagcctcgacttccttttctggaaactcgaggctttgtttttattaatatgaagaaaagcataaatattaagctataataggtttaaatatgttgtaaccatgtagtaagaaaacaatgagaggacagcacatggaaaaaatctcagtaattatcccggtatataacgatgaaaaatatttagctcaatgcttagatagtgtcttaaggcagacttattctaatctagaaattattttagtagacgatggatctacagatagtacacctgaattatgtgaaaaataccgtgaaaaatatgccaacataagaattttacacaagaaaaatggtggagtaggctcaagccgtaatgctggtcttgaaatggcaactggtgaatatattttgtttgtagatcatgatgatttgctgggtgaaacccatattgaagaactttataagctgttgaaaaagaatgatgcagatattgctgtaggaaattttaatcattttattgaagaaaaaagagcatatgggatttggcttaaagaagatgattactttgaaaagacctacactccagaagaatggtttactgtagaatatgagacagtaccttataatatgtccatcatttttgctgtgccatgggcaaaattatataaaaaatctctttttgaaaatatagtttatcccattaatgctcgcgtagaagatgatctaactacatggaaaatatacttattagcagataaaattgcatacatgaataaagcaatttatacgcaccgtatttttgaaaatagtgtctctgcacaggctaataagactgccgttttccctttagaagctgtggaagaaagaataagtttgttaagtcagctcggttttgatattacaacagaaattgaagcatatcactatcgtctaaatatttgtatcgatacagcattaaaggacggggattacttgaaatatcgtaatgccaagcagaaactggcgatcttgaagaagtataaaaaaatatagtttattaaaaataaaactccctgagaataaataaaattctcagggagttttttagttaattattgtattgagctttcaccacagcatcaactaatgctttcttagtaaagtaaccattacgaattaaactactaaaattattaacgctatcaaccatttgcttgtagtcttcatcattaatttgaaggactttagcttgagcttcatctaaactatcagcaataatacctagatgtttgttttttatagtttcagcttctggagtagtgctatttacgataattggcaagcctgctgctaagtaggtgctaagcttgtaagaagcgtttactttcatatattcagaccaatatggctcttcagaccaaactaaaccaaacccaccggtttgacgtaattcttctaataaaacaggatcatgtttccagcccgtaagttcaacgttgtgttcgggatcgttatttactggatctgaataaacttttaattttacattttgacagtcccatttttttacaaaatcaaatttttctgcattacctgcgaagttaattactttattgttttcaggggtaatgaagtaatttactgttgctggatgatcccaaaaatgttgtaccacataaggtttttcctttaatccgttttcccttaaaaggtcatacattttttttgagggtacaattaaaacatcagccttattatagtagtcaatatattgcggcatcagatagcgattaacttcaaacattagtggaatcacatcatgaataaagatgatttttttaatattaggataaagattgatatggtcaattagtgcttggtcccattcaattgcgatccaactaggagattgaaaaatgacggtatcaccaccgttaagggaggcaataatcccatcaaaacgggtgcttctggcctgtagtggttcttctgtccaatgataaacataaattccaaattcattcatgcctagttgttttgcaaaatctacaaccatattttgggcattctgagctacgctattcatagccattccatttatatttgtaatatgaactgtcatcataaatctccttagaacttcatctttccttaattataagtataagaaagaaaaaatttttttacaacacaggccttatttaatcattgagagtatatttaaaagttagttttaaacatttttaattaagtattagatgtaatttagcgacgtatgtccaatattcggtctacgctcaatattctataataatctgttaaatttataataagaaattatttaaaaagagacaaaataaaaatcattcagtttgctttatgttgcattccgaatgattttttacttctaataattattagctaaagcacccattggatcccaaggaagtaattgaattggatctttactgccttcttcaaaagtcttctttaagtcatcgctaaggtgtttcttgttgataactgcttggtaaacaaatttatcgaaccagctgtcactcattacaaagtaacctttaaatccaggcttttcaccccaagaattttcaatcttccacttagttggcttgccatctactaggtcaacacctgtaataaccattgcgtggtccatcaagctttcgcctgaatcaagcatgtcagctttagacatgtcaaagtcaacatcaaataagtcgtcacgtttatataattcagtatcaagtaaaccagcttgacgttcagagtctttaacaacatttgatccaaaccaaacaacttcaccgtttttaagttgagtgataatcaaatctttcatttcatcaattggtaagttcaagtgacgtacttgacgtccgccttccacatttcctaagtattcaacagaaaatactttatggaaaggcttgtctttagttggtgcattaattgtggaaatgtattcacttaagtcccaaccaacatactttttaaagaagtcttgtggacttaaggcagcatctctatggtagttaccatcatcatctttgtattcaaaatcaaaagttttaggtggaacaccaagagaaatagctaaaatacggtaaacttctttaagcatttcgtttttgcgttcttgaacttcttcttcactctttccatcttgaaccatcttacgtaattcaagaccatcttttctaagaagggtatttagagtgtcatttaaagcacttgaattagttgcattagcagtttctgggtaaactttctttggaacaataccatatttttcaattattccgcaaagcatatcccattgaccaccgtcttgttgtggggttgcaaataggaaggcaactttacgatcacccaagtctttatcggcagtagcaatcacattttcaaagaaccagtttgacttttcaaatttgtcccagaagttagtgtaattttgagataattcaaagtccttaattttgaagttcttttgaattgaatgacgcatagtgtttaaagcactgaacatccagcagcggccagattgtttttggttagcaactttgccagtatcaatttcaattgaaaaagtagggtctaagtcaattttagtttgtagattctgactagctttaaaaataccattttcttgagcagcacgagccgcaattttgttagctttacttgagttaaagtcattttcgaaattattaataagatcgtttgtgatttctttactcataaaatcctccttaattaaaaaaagcttaattatattttagcttaaaataaagagttacgtctagtcatggtatttaaaatttgaatatgatataaataatttttttattagtctaaagctttattaaaaaaatagataaaagagacaattagatgcttctttttgttattctgatcacggaatttggaggaacaatatgaaactcaagaaaaaatatttatttttctcaatagttgggattttaatagtagcggttttaggaatttttggttatgaataccaaaaaattcaatcgacggctaatactatttctactaatcattctttagccagtcgtcagcaattaaaacaaggaaagccattttcaatcttggtattaggtactgatgtgggagccttaggacgaggaactagttatgctggaaatacagataccttggaattaattactgttaatcctaaaaagcatactttaactacaactgctattcctcgagataccttagtaagggttgaaaccaaaaataagatagaatataccaaaattaatgcagcctatgctttaggcggacctagagaaataaaaaagcaggttcatgaattactggatgttcctgttgattattatgccttggttaatatgggtggattagaaaagaccgtaaacgctgttggcggcgttactgttaataatccttttgcttttaagtatgaaggacatacatatcctaagggaaaacagtatttaaatggcagcgaggctttaggctacagtagaatgcgatatgatgatcctgataatgactacggccgtcaaaaacgaggccagcaggtgctacttagtgctctgacaaaagttaataaatcaaaaaatattatgcaaatgaattctttactcgacacagccaaagataatgttcggactgatttacctttagatgatttaatgactctatataagaactatcatggagcattagccgatactcagagtgatcatttacaaggaaaaaatgcgacaattgataattttagttttcaaatagctccaaattgggaaatgcagcgtttgtcagataatacccgtcaagcactaggattaacaaaggttaaagttaataatattcaaactaaaatgaatgatatgcaaactaactggaatggctataataatgtaaattatgttttaccaaataacgctcaagtttatattccagttaataaagtatgataaaaaataaagcacttattggcccaaaaaataagtgttttttcgtatatataagtaggacaagtataataaattaacgtaaaatataggtctaagtgaatgtaagagaggataaaaatgaaaaaacgtggttttgaaatagtatctaaataccgtaatgcaggcctccacctgcctcaacgccaaacaattgcgagtgcgggctatgactttgaatgtgcacaagatatagttttgccatcaatttggtgtatgaactttgttcgaatttttagactaattagaaatggtcatgaattaaatgaacatgatctggaattagctgaaaaagtattgaaaccttttttagtacccactggaattaaggcgtacatgccagaggatgaagtcctaattttagctaatcgctcttctaatacttataagcgaaacgttactttgccaaatgggatcggtgtaattgacagtgactactataataatgaaaaaaacgaaggtgaaatttactttcaattaattaattatggcgttcgtccactaaagatcaaaaagggtgaacgaattggacaaggaatttttatgccttacttaaaggcagataatgatgatccagttcaaagacagcgtcttggaggatttggctcgtctggaacaaggaatgatgactaatggcaaaagttaaaactcgttataagtgtcgtaattgtggatatatttctgcttcctatcttggaagatgtcccaattgtggtgcttggaatcaatttgaagaagagacacaggaaattaaaaaagtatcaactaaggcaactgcaagccgtctgatgactaaaattggaaataatgatccagtaaagttaactgaggtaaaagctgagaaagaaaaaagaattgtgactccttttgaagaattaaatcgagttttaggaggagggattgttccaggatctttagttttaattggaggagatccaggaattggaaaatcaaccttaatgcttcaaattactggcgctttagctaaagaacatagcgtcttatatgtttcaggagaagagtccgcaagtcaaataaagatgcgggcagatcgattaggagtaagcaatagcggaattttgctttatccagaaacaaatatgcagaatattcgtgaccagattgatgaaattaagccagattttttggtaattgattctattcaaacaatgaatgaaccttcacttgattcaatggttggatctgcttctcaagtacgtgaagtaacaagtgaactaatgaaaattgctaaaaatgaacaaataactacttttgttattggccatgtaactaaagaaggagcaattgctgggcctaagattatggaacatatggttgataccgttctttactttgaaggagatgggcaccactcatatcgaattttaagatcagtaaagaatcgttttggtgcagctaatgaaattggaatgtttgagatgaaaaatgaagggttagcagaagtaagtaatccttcagctattttcttagacgaacgcttacctaattcgactggttcctcagttgttgtttcacttgaaggaacgcggcctcttcttgcagatatccaagctttagtaaccccaacagcattcggatatgcaaaaagaacaacttcaggattagattttaatcgagtagcacttttattggcggttttagaaaaaagaggcaacttaatgcttcaaaatcaagatgcttttctaactgcaactggtgggattaaattaaatgaaccagcaattgatcttgcaatttgcatggcggttgcttcaagttacaaaaataaagaaatttcttcgactgattgctttgtaggtgaagttggcttaactggtgaaattagaagagttaatcaaattgaagctagagttaaagaggccgcaaaagtaggctttaagcgaatttttattcctaaaaacaacttaaaccaggagcttaagaataactctgagatcgaagtaattggagtagcaagtttaccacaagctttaaaacttgtttttaactagcagagagattgaacttttgctcgttaaaagttacacttaaatggatgaattttaataaattttgaaagaggcgctttaattttggcaaaacaaaaaatccgcgttcgttacgcaccaagtccaacaggtcacttgcacattggtaacgcacgtactgcattatttaactatctatttgcacgtcacaataaagggacaatggtcttaagaattgaagatacggaccaaaaacgtaacgttgaaggtggttctaagtcccaaatggaaaacttgcactggttaggtattgactgggatgaaggtcctgacaagggtggcgactttggcccttaccgccaatcagagcgtaaagacatttacaataaatatattcaacaattaattgatgaaggtaaagcttactattcatacaagactgaggaagaacttgaagcacaacgtgaagaacaacgtgcaatgggaattgctcctcactacacttatgaatacgaaggcatgactgctgatgaaattaaagaagctcaagcagctgcagaagcaaaaggcttaaagccagttgttcgtatccacattcctgaaaatagaacttatgcttgggaagatatggttaaaggtaaggtatcatttgaatcagatactataggtggtgacttcgttattcaaaaacgtgatggtatgccaacctacaacttcgccgttgtaattgatgaccacctaatggaaattactcacgttcttagaggagacgaccacgtagctaatactcctaagcaattagttgtttatgaagcacttggctgggaaccacctaagtttggtcacatgactttgatcattaactctgaaactggtaaaaagctttctaagcgtgatgaatcagttcttcaatttattgaacaataccgtgaccttggttacttaccagacgcaatgttcaactttattaccttacttggctggtctcctgttggtgaaagtgaaattttttcacaaagagaattgattaagtcatttgatcctaagcgtttgtctaagtcaccagctgcttttgaccaaaagaagcttgaatggattaacaaccaatacgttaagaaggcagaccgtgatcttttattagatcttgctttgaataacttacaagaagcaggtttagttgataaagaaatttcaccagaaaagatggaatgggttcgtcaattagtaaatatttacgctgtacaaatgtcttatactaagcaaattgtagatattgctaagatcttctttgaagaagctccagaattatctgatgcagaaattgaagaaatcaagaaagacgatgctcgtcctgtaattgaagaattcaagaagcaattaaatgctgttcctcgctttactgctgtacaagctatgaacgcaattcaagctactcgtcgtgaaactggggtaaagggtagaaaattatttatgccaattagaattgctgctactcgttcaatggttggacctggtattggtgaagctattgagttaatgggtaaggaaaaagttaacaagcacattgacttaactttaaagcaattaagtgatttaggtctttaattatttaatacagttaaagctacgtgaaagcgtagctttttttgttagaatagttatgaaagaatgtcttaaatgaaagagggatgatcatgaaggtctttaatactttaactcgaaaaaaagaagagtttaagccattagtagctggaaaagtaagcatgtacgtttgtggaccaactgtttataattatattcatattggaaatgcccgcagtgtgattgcatttgatacaattcgtcgatattttgagtatcgaggctatgatgtgaattatgtttctaacttcaccgatgttgacgataagatgattaatgaggcccgtaaagaacatacaactgtcgaaaagcttgctgaacgctatattaaggcttttatggaagataccgaagcattgaatattgagcccgctactcttcatccacgtgcaactcatgaaatcaaagaaattatcgactttgttcaagatttaattgataagggcgttgcatatgaagtggacggggatgtatattaccgtgctagaaaattccctaattatggtcaactaagcgatcaaaatattgctgaacttgaagaaggtgcttctgagcatattaatgaagaagaacaaagcaagaaagaagatccaattgacttcgccttatggaaggctcaaaaagaagaggatgaaattgcttgggattctccatggggaaaggggcgtccaggctggcatattgaatgttcagtaatgtcaactaaatatttaggcgataccattgatattcatggtggtggccaagatttggaatttccacaccatgaaaatgagattgctcaaagtgaagctaagaccggtaaaaaatttgttaattactggatgcacaatggttttgtgacagtaggtaagaaacaagaaaaaatgtcaaaatcactccataactttgtgactgtgcatgatattctaaagcaaattgatccacaagttttacgtttttacatgtctagtgttcaatatcgtcgcccaattaactattctgaagatggcttaaaacaagctgaaactgttcttaaacgctatcaaaatactttgcgtaatcttgatgctagactaaatgatgagaatgagacgcttgaagataatggcttaagagatgatttaacacaagcaaaagctgaatttattgaggccatggatgatgattttaatgttcaaaatgctttgagcattatgtacgatttggctacaactttaaataatcacttgcaaaaagatcaagtggataagccagctttaaagcgtgctaaaaaattattgattgcttggctcgaaatttttggagttagctttaaggaagagcaagctgaaaatgatgatgaaattgaaaaattaattgctcaacgcgatgaagcacgtaaaaataaggattgggctgaaagtgaccgcttaagagatgagttacaggctaaaggcattgtaattgaagatactccacaaggaacgaggtggcaccgtgcttaagccgaagattttaacagaaaaaaatactaatccagatgggttaggtcctcttactttagcttatttaggggatggggtatatgaggtttatatcagacgccacttggttaagggtggaattgtaaaaccacaaatgcttcaacgatatgcaacacattatgtttccgcaaaagctcaagcagcattaattactaaaatgcaagacttagaaatgctagatgaagatgaattagcagccttcaagagaggaagaaatgctaaaagtcatacgcatgcaaaaaacacttcaattaacacttacaagctctcaactggatttgaagcgatgtttggatacttagatttattaggtaaaaaagaacgtgttgatgaacttgcaaaatggtgcattgaccaagtagaacaaggaggactagataattatgagttcaaataatgatgaatttgtatatggacgtcatgctggcattgattttttaaaaacacaggatgctaacttaattaataaagtatttttacaaaatggtgttcaggaagaatttgctaaccaagtttatcaattagcacgtaaaaaaaatctagttgttcaaaatgctcctaaaaataagttggatcaaatggttaaccatgaaaatcaccaaggtttggttttaactgtagctccatttgaatatgctgatttagatgaactcttagataagtttgaccaagaaggaaaagaaccatttatcttaatgcttgattcaattgaagatccccataacctaggttcgatcttaagaacttgtgatgcgactggcgtggatgcagtcattattccaaaaagaagagcaagtggtttaacttctgttgttgccaaaacttcaacgggtgcaattgattatgtgccagtagctcgagttaataacttagttcaaactactaagatgctgaaaaagcgtggttactggatttttggtactgccatggaaggtgaagattatcgtaagtggaatgccaaaggaaagacagtgcttgtgattggtaatgaaggtaagggaatttctccattattgttaaagcaaatggatcaaactttaactattccaatggttggacatgttcaatcattaaatgctagtgttgcaactggtgttttactttacggaatgttcaatagtcgtcatcctgaaaaataattaaagattagaaaaaattgtcatttagttttataaagagctaagtgacaattttttattgcttatagttataaaaacagacacacaataaagtcttgatcattaacaaagtacaattgctctatacctgtgattaataaacattcgttcccttagaatgagattttttcttttttattcttattaccaaatagaaaaggaggaatttccggaatggaaagattgaatgaagtttatttgattcgacgtgtaaaagaagagcaagatatggaagctttgcatgaactagtagagcggtatcggcctttaatcaatggagcgaaactaaattttttcattcgcaattttgatcatgatgactgggaacaagaagcattaatcatgtgttatcaaagttgctgtacctacgatgagaaatgagcaaatagttttggggcgtattatcggacaaaattttataatcatctccgatcactcttaaggtatgaattagcacagaaaagaacgtcttttactaaggctatttcctatgacaatgtggtgcataaaaatttgattaaagaagaagttgaagagatgcacatcacacctagaaaggaaatgtatcaaaaatttattaacaagttgtcagaaaaagaggtaattgcgctcaaagtttttctgggagagttaacgattgaagaagcgagtaaggagacaaactatagtcgttatcaattacttcaagcgaaagctcgatgtaaggcaaaaatgcggaaagaattgttttaaattcgcatagaacgaataaaaagactataataggttttgtagaatttatttaggaggtaattttaagatggcagatgaagttattaagacagaattgttagaccgtcacatgaaggaagtttttgattggagcgattctgacatgcctgttagagacgcactatgggactactttatggaaaagaatggtagagataccatgaagacggaaagtgacatgcttccgttcttgaaagactctgacgataagatcgaagccttcgtcaacgaaaatcttaagaagtaacatcacctaaaaacaataattctacgcacagtggtcacgcattgtttgaccaccaaagaacaatctctagggattgttctttttttgtgagaaaatatattttaaaagaaaggggcggcttatggactatataattgggatggatatcggaacaacagcaagtaagggtgtattgtatcgaggaaatggtaaaaagattgaagaattatcaattccttaccctttaattcaagaacaagtagatcaggctgaagaagatccacaagtaatatttaatgctgttcaaaagattatttttgacttaagtaaaagagttgcaggaaaaattaaagcaatttcttggtcgagtcaaatgcatagtttaatcggcattggaaaagacaatcgagtactgactaacagtattacttgggcagataatcgaagtagccagcttgtggctcaagcaaaagaaaatggtcttgcgcaagatatttatcaacagacagggatgccgcctcatccaatggctcctgtgtataaattactgtggattaaagaagaaaatcctaaactttttgcacaggtgcaaaaatggattggaattaaagaatatattatttggcgtttaactggcacgatagtgaccgatacaacgatggcagctggaactggcttgcttaatctccacactttaacttgggataggaaattacttgataaaattgaactagatccagaaaaattgcccaacttagctaaaccagaatatgtggttggaaaagtagaagcagaatatgtacaaaaattgggtttaaattctgaaacaaaaattattttaggagctagtgatggatatttatcaacaattggtgttggtgttttagataaaaaatactttgcactaaatgttggtacatcaggggctgtaagagcaattgcacctaaagcaatagttgactcaaaaaatcgcttcttttgttatccagtcgataaaagtcattatcttcttggtggcccagtaaataatgggggaatcgtctttgagtgggctagaaaaacgatttttgggcccgatcaaactgcagaagattttattaatgttgctgaaactgttcctgcaggcagtaatggcttaatttttcatccctacttagggggagaacgagcaccaatttggaatgctcaagctcgcggatcttttattggattaagtcgaaaccacactaaaccgcaaatggcgcggagtgttttagaaggtattgtctttaatcttttaggtgcagctagaggcttacgcgaaaaaataggggaaccagaagcattaagagtcactggcggctttgtaagaagtgattttgtaaggcagttaattgctgatatttttaatttaccagcagtggtaattaaaaatgatcaaagtggaactttagcagccatgtttctagcacaattaggcttgaatgaagaggatagcttagacaaaatagtgaaagaaatagatgacagtaaagtatattttccaaatcaaaaaaatgtgcaggtctaccaggatataattccgatctatcgagaagtagaacatgatttagaccaaagctatgacaaaatagctcaatttcagaaaaaatatcctaaattatttgaataataaaaaggtaaattgtatcaaattagtacaatttaccttttttctaatataaatatgaatttgacttattttagaattcctaaaatatcactaacaatttgatcaggcattaaatgatcacgcttgtagatagattcttttggttcattatcagtgtattcctttttagcaccataattcttaaccatcatcttagttggaccatagtagctagcaatcttttgaccaaaaccaccatcaatactgttgtcttctagagtaacaactaattcatggtcgttttgaagtttatctaatgcgtcataatcaaggtgagcagcagattttggattgatcaaagtggcattaatgttttctgtctttaataaatcaactaccttttcacctaattgataaaagtcacctaaaccaatgatggcaaccttagaaccgggctttacatcatacttaatagttgaatagtcttcatccactggttcaccttctggaattggatttactggagatttaattgctatgggatgctttctttgcttaactgcccattcaagcattgattttaattcattcaaggtggtaggagctaagtattcccagtttggccaatttgcgaccatggcgttgtcaaaaatacctaagtgggtcttagaagtgccagtaattccgccgccagctaccaccattacgactggtaagtcgttagctgctacatcgtgagaaagttgatcataagcacgttgtaagaaagtggagttttcaaataagactggggtaattccttctttaacagcccctgcagcaaaggcaacagactcttgttcagcaattcctacatccttataattcttagggtatttattcttaatctcacctaaaccaaagacgccagggatagcagcattgatggctaagatgttttcttgattttcaatatgtttctttaagaaatccaaaactacagtagttggattaggagtctttggagctggtacagttgtcttgtccgtcttaagatcaaaaggcaatacccagtggtgactagcttcattttcaatagctggctcatatcccttacccttaagggtattgatatgtaaaacaattgggtggtcaatatctttaattgatttgaaggcatcaatcattgctttaagatcatttccctgatcaacatatttataatctagtcccattgcagtaaatggattatcagctgtttgaccatttgattcacgtaatttcttcaaagcagttacaacaccgccgacattatcatcaatcgacatttgattgtcatttactacaataattagattatgcttttcatcagccgcattattaaagccctcaaaggctaagccaccagttaaagaaccatccccaataagagccgtaatattttcatgttctcctagcatatcacgcgctctagccattccagttgctaaagcaattgaagttgaagtatgaccaacagcaaagtagtcatatggactttcctcaggattagaataaggagttacatcctcgtacttatcgggatcaagccaaccataagcacgtccagttaacatcttgtgtggataagtttggtgagaaacatcccaaacaatcttatctttaggtgcatcgaaaacataatggtaggcaattgtagcttcgacaattcctaagtcaggtcctaagtggccacctttagcagcatctttttctaggatcaaggttctaatttcactagctagttgttctagttcttttagatctaattttttaagatcttttggacttttaatcttgtttaataaaaattctggatgtttgttcatattttttcaccccaccattaataaaaaaagcttactcatttattgtaagtcaatgagtaagcttttactaatattaagttagcatagataagtataagattaatctatactttcttctaatggttgagatgcattttgctttttgagagtaaggaacaaagcaacaaaactgagcgcaaaagcagttgcgttgattgcccaaccgaagttgtaagaaccagtagtatcaaataaaagaccgttcaagtaaacagatgcagacattgcaaatgcaccagtcatattaattactgaaagaattgtactgtagtccttagctccgaattcttctcgaataaggtaaggaagagcaactaaacacacaccttgacccaaacctaaaataaaggcagaggcaataagtggaagactagtcttaaagaaaatttcgccgctccagcctaataagccaaataaagaataaataaataaagtagctcgtgtattaaaacgatcaagcataaaaccaatagaaatcttaccagctgctgctccaagcattaccccagaaactactgatgcaccaattgttaatgggagaccttggctggtaatatgacctgaaatatgttgcacagatccagaaacaaattgcagtgcaagcattgcaaatgctaaagcataaaagacaggggtcttaagagctgccttaagggtaataccactagtttcaagaactttttctggtatatttttcactttgccgtatgcttggtgtttttgattaggtttttctcttaagaagaatgctgaaggaactaaaattccgagaattagtaatccttcgcagatgaagccacctctccatccaaagttggtaatgatgttaccaataattgggttaaagatggtgccaccaaaggctgaaactccaagggcaattcccatcacagttcctaatttttcattgaaccagtttcctaataggacagggatggataaagtaatagcaattggttggcaaatcccaatgatgatccaagcaatataaaaatgagttaaactttgtgctactgataagctaagcatggaaactccaattacagcaaaacagaaagttaaaagccaacgcaagttaagtttggtcataattttacctgcaaatagcaaagtaattgcggcagcagcattttgcaaggttgtcattaaagcaacgcttgctcgaccaacatggaagcttttgctaattggttcaaagaataaaccaatagtattaacaattaatccaaatcctactaatgaaattaaacaggaggcaataaaaacccaccaggcaaaaaaatgcgaattttcttttttcttagtcacttcttttcctactttctagaattataatccaaaaaaagattatagcgaattagtaaagaatagggaaagaaaagagacgctcttaacattctcttaattaatagcttctttttaataaaatatctgttagcttttcaagttgctggcgagttttgttgtctggccaatgtttttgcaagttgtgtaaagctttatcagtgaatttatcagctaacttttgtgctcgctttaccccgtcaagatcattaaccattttttctatctcttgtagttgttccttagtcaaatcttgtcctaatttaactaatttatgtaaacgccccgtatgatcattttgtaaggcaaaaattaaggggcctgagtagataccatctttaacatctaataagactggctttttaaaagtagaactagtagttgtatagtctaaaatatcatctcttagctgaaaagcttggcccaagtagtcaccaaactttttagcttttagagccttagttactttaagaccactctcataagcgccaataaaacaggctaggccaaataagacaccagttttacccttaatttgatctaagtattccttttcagaaatattaatcttgtatgcattgttatactgctcggtttcgccgactaggatattttgcatggtttttccatctgcaataacgctgtgtaagctttgagcattttcacttaaaagagtgagtgataaagcaaataaatagtcgccagcataaactgcgatatgtttaccatattttgtttgaattgaaggtctgccatggcgcatgctcgattcatcgataatatcatcgtgaattaaggtagcattatggagagtctcaattgaggttgctattttttgtagttctttgcgcttttcatgaccatttggcccaaaagagccaaagagcattacacaagcaggacgcagcattttcccaggagaagcaaaagtatcttttaaggcgtctcctagtagaccgggaacagtatttacatgttttaagataatacgattgatggcaatcatatctttttgagtttctggaaaattgtcccaaaaagtgaaattgctcttgttattgtttagtttttcgggaagtgaattttgtagtggataagttgaattttctgccatgataaatatttaattaaaaggaaaagttgctccttttaattaataaatcctcccaatcagttgaatatcagcataagagcagttaaaattaaacggaaataaagttaatgaagtaaaattgttattttttatttcattttcaattttgaagatagctttatttttaattaaaaaagatcttataagtataattctacactatctattaatattatttaaaaggagatataattttttgatgagtaaattagattcttctttactttattgataggaattgctaaaaaaagatttttttgctaagataaatgcagtttaggagtggttttatggcagtaaagaaagcagctcttgcatgtactgtatgtggttctcgcaattattctattgcagcaagcaagaatagaacgcaaagacttgaacttaagaagttttgcaagcattgcggaaagcaaactttgcacaaggaaacgaggtaggtaagcaatgtttaagtttattaagagtgttaaccaaactatggcaaaagtatcatggcctacatggaaacaaaatagacgtgatacaggtgttgtaatcatcagctcaattttgtttggtgcttaccttggtttgctagatttattatttagctacttaacgcaaatgttcttataaaaacagtatatgtgttataattaaatcagttaaaaaagcctccctcggaggtttttttatttgcataaaggtattattttaaggagtttagaaacatggttgaaaccagcgaaaagaaatggtacgttttacacacttattctggctacgaagaaaaggttaagaaagatttactttcaagagcccaatcaatgggtatgcaaaattatatctttcgagtaattgttcctgaagaacaaaagactgaaactgttcgtggtaagaagcaagaagtagatgaaaaggtatttccaggttacgttttagtagaaatggtaatgactgatgaaagttggtatgttgtcagaaatacgccaaacgttactggatttgttggcagtcacggtggtggatcaaagccatctcctttatacgatgacgaaattgaaagaattcttgcttctcaaggccaaccagctaaagaacctaaagctgactatgaagttggtgaaacagtaactattattgatggtgcatttagtggcatgagtggtaagattactgaaattaacccagaaaaagataaactttatgtttctattgatatgttcggcagagaaacaaatgctgaacttgactataaccaagtaaaagaatttgaccaataataaaattttaattagctattgtcaatttaataaattgctggtagtatattagagtatctttattattgtgggaggagaagaaggaaaattctccactataaccgcatcacggaatcaaggaggtattgaccgtggcaaagaaagttattaacgtagttaaactgcaaattcctgctggtgcagcaactcctgcacctccagttggtcctgcattgggtcaagctggaatcaacatcgttggtttcactaaggacttcaacgcacgtactgctgatcaaaagggtatgattatccctgtagttattactgtatatgaagatcgttcattcgaattcattactaagactccaccagctgctgttcttttgaagaaggctgctaaagtggacaagggttctggtgaacctaacactaagaaggttgctaaggtaactaaggaccaagttaaggaaattgccgaaaccaagatgaaagatctaaacgctgcagatattgaagctgctatgcgcatgattgaaggtactgctagaagcatgggcttcactgtagaagactagtgtttttaggaacgtcggatcgttaatcaaaattaacgaatcaaggtgggagagtgtgagaagactcgtttgaccacattttcaggaggatttttacatggcaaagcatggaaagagatatttagaagcagctaaaaaagttgattcaactaaattttattcagtagatgaagctatgaagttagcaaaagaaacttcatacgcaaactttgacgcaactattgaagttgcatataacttaaacgttgaccctaagcaagcagatcaacaaattagaggtgcattggtacttccaaacggtactggtaaatctaagaaggttgttgtttttgctgaaggtccacaagctgaccaagctaaagaagcaggtgctgacgaagttggttctgatgatttagtagaaaaagttcaaaacggttacttagactttgacgtagttattgctactccaatgatgatggctaaggttggtcgtttaggtcgtatcttaggacctaaaggcttaatgccaaaccctaagactggtactgttactatggacgttgctaaagctgttgaaaaccaaaaagcaggtcaagttgaataccgtgttgataagcaaggtttaatccatgcaccaatcggtaaggcttcatttgacgctgaaaaattagcacaaaactttgatgcattacgtgacgttattcttcgtgcacgtcctgcatcaactaagggtcaatacgttaagagtgttgccgtttctgcaacctttggccctggtatccacttggatccattaaacttagactaattaatagttgtttaattaagcaaaaagacttcacaattgtgaagtctttttttgtactaaggttgaaagtgtaatgagattttagttaaaattaaacaatacgctatttttagaacaggaggtgaaggggatgctaaattatatttttagtattttgccttcattattttccggtgcttggttaactattgagatctttttttggacgacagtagtttctattccgctaggtttattagttgcctttggtttacattcaaaattgaagttagttaaagctattttaaaattttatgtatggattattcgtggtacaccgcttttactacaattaatttttattttttatggtttaccaactgttggaattgtctttccaagatacgaggctgccttagtcgcatttattatcaattatgctgcttactttgcagaaatcttccgtggtggactgcaagcagtacctgtcggccaatttgaagcagcacaagtgctaggcttaagtagatggcaaacaattaatcgtattgtacgtccacaggttgttaaaattgttttgccttcaattggtaatgagctgataaacttagttaaggactccagtttggtctatgtaattggtttaggagaccttttacgtgccggaaatgttgcgactgcaagagacgtgtctttagttccactagtattagtagggtgtgtatatttggcaatgacagcagttttaacagctttattgagagtagtggagaagagaagcaatgtctggaaataaagttttagaactcaagaatataagtaaaagttttggcacaagaaaaattattgataagttgaatttgtcactagatcaaggagatatcttaagtattattggcccttcaggtgcaggaaaaactacactgcttcgcttgattgcaggacttgaaagtgccgatagtggaaaattcctccataatggaaaagaatttgatccaacagatcgtaataatcatttagtagggatggtttttcaagattacaatctttttccaaacctttcagtaatggataatattacgcttgctccaattatggtaaataagatgagtaaagcagaggctgaaaaagcagctgcgcctgttttagatcaattagacttagacaagtttaaaactttatatccatatcaattatcaggaggacaaaagcagcgtgtagccattgccagagccctgcaaatgaaacctgaaatcttgtgctatgatgagcctacctctgccttagaccctgagttagtagggaaagtaaaagatattttcttaaagcttaaacaaacaggaatgacgcaggtaattattactcatgatcaccagtttggaaaagctgttgctgataaaatcttaaaagttgagccaatagaaaaatgatgaaaaaaataatacgatttttgggtctattgatcattgtgctagcttctgttggtgtggttggatgtcaaagacaggaaaactcatggcaggcgattaaatcacgtggtactttagtaattggtgttgacgacagcttcgtaccaatggattttcgccaaaagaatggtaagcttgttggttttgatgttgacttagccaaggccgtttgcaaggagattggtttaaagcctgattttcagacaattgattggtcaatgaaagaaacagaacttcgcaatgggacaatagatgttatctggaatgggtatactaagacgaaggctagggcaaagaaagtagcattttcaaaaccatatcttgaaaatgatcagattctggttacacgaaaaaatgaagggataaataattatcgacaaatgaaagggaagattcttggagttcaaacaggatcttcaggagccgatgatttggataattatcctaaagtcttaaagaaacgtgtcaaaagtacagttttgtatgatacttataacaatgcctttatcgatctaaaagctggcagaattgatggcttattaattgatggggtatatgcaaattattatttagctcatagcaagtatcaaaaagaatttaaaaaagaaaaattaccatatccaagtgaaaaattttcagtaggaatcaataaaaaagataaaactcttaaaaacaagattaatcaagctcttgatcatctagagaagacaggagagctaaaaaagattcgcgaaaaatggtttaattaaaaaaagctattgacgacttatctaatttaaggtaatatattgtacagtaaattctacctaagactcgggtggctaacgtgccttaatatcccgccgaggccagaaaaacaaagagttttacaactccatgtctttttggcatggagtttttatttcggctgatagaatttatcttaaagtaaatttggaggtgaattcgttgagtaaagcaatcattgctaaaaaagaaaagcttgttgatgactttgcagcagaacttaaggaagctaaggctatcttagtaattgactacttaggtttaactgttgaagaagtaactaacttacgtaaggatctacgtgatgctaacgttaagatgaaagttatcaagaacacttacttaaagcgtgctgctgaaaaggctggtattgaaggtttagaagatacttttgttggtcctactgctgttgtttacactgctgatgcagaagacatcactgaaccagctcgtattgtttctaaatacgaagatgatatcgacgcattatcaattaaaggtggtatgctcgaaggtaaggttgccagccaagaagaaatcaagaaacttgcagctattccaggtcgcgaaggtttactttcaatgcttgtatctgtattacaagctccagttcgcaactttgcatacgctgttaaggctgtcgctgattcaaaagacgaataatattagtaaatttacacatatctaatttcggaggaaacttataatggctttagatactgaaaagattattgaagatttaaaaggtgcttcaatccttgaattaaacgacttagtaaaggctattgaagacgaatttggtgtttcagctgctgctccagttgctgctgcaggtgctgcaggcgcaggtgcagaaaagactgaatttgacgttgaattgactgatgttggtcaagaaaaagttaaggttatcaaggttgttcgtgacatcactggtcttggccttaaggattctaaggaccttgttgatggtgctcctaagaacgttaaggaaggcgtttctgaagacgaagctaacgacatcaaagctaagcttgaagaagttggcgcaactgttactgttaagtaataacgtcttaactgaacatcctactgaaaatgaggactctattttacggagtcctcatttttgtttacaataaaattatgtttaagaaaaatttttataaatggtttaaagctgctttagctattatttcaattattctgcttgtgttagattttgcggcaataattgatattaatagtaggaatagtaagtggttttggctaaataaccttattttaattattttggcaatagattacttttctcggctctatcttgcaaaaaataagaaagtattttttagaaataatatttttgagctactagcaattattcctgttggtcttgcctttagttggatgaaactggctcagttgggagatattggtttatattttaggctattacgtttaatccggttggctgggctggtgggaatgctcaaagatatattacatactcatggtattttatatgtaatatactttagtattgcctttttgatgttaggatcagttgcaatttcgattaccgagcatgtttcacttgatcaagcattctggtgggcagtaactactgcaagtactgtcggttatggagatatttctaaacacacgatttcaccacaatctttactgggaaaattagtgattttagcgatgattctgattggagtaggggtgatgggaatcgttacgagttctcttactgcttatctgatgagaagaaatgaggggaaaattagtattaaagacaagaatgctgatttgaccttaattttagataaattagaccggctagaagatcaaaataaaatgttggctgagcaaaatcaaaacttacaaaaacaaatccaagaactaaaagaaaatcgtcctcctagagagtgggataaacttaaggaatggattgaaaagaaaaaagacaaaaattaaagcgtaaattcattttcgaatttacgcttttttacatcttcaaataaaaatgtagaataatcatgaatagaagataacaaccagcaataataatgataacccaaccggctgttaaccaaaatcttgcccaggtttgtctatttgttgaaagaacacgaccaaaaactgcttgattgccttttattctaaatcctacccataaacagataattccaataataattgctaaaataaatataggaatagaaatcatcattctatctcttcctttctgtaacattctaattataaggctttatggaaaaaaacaaagcagaattgataaactataaatagaaattaaagaagcgagaataattatgacaaaaaagaatcaaatgtattttgcggctaatcctgatgccaagcatgatgaacacttagttgattatcatattgatgatattgatttaaaatttacaactgacgcaggtgttttttcaaaattaagagttgattatggttccggcgttttaataaaggcaatgaaaaacgttgattttccaaaggatggaatcttagatgttgggactggttacggtccgatgggattatttgcggctaagttttggcctgatcaagaagttgatatggtagatgtaaatgagcgtgccttagacttagctaaaagaaatgcacagtttaatcggattgataatgtaaatatttatcagtcagatatttatgaacaggtggataaaaaatacgggctaattattactaatccaccaattcgtgctggtaaaaaggtagtcgaccaaattttggctgacgcaaaagaccatctagtagaaaaaggcgtcttattggtagtaattcagaagaaacaaggtgcacctagtgccaagaaattaatgacaaagatatacggaaattgtgagattctagctcgtgataagggttactacattttaatgagtacaaataattaaaaaaataacaataaaggtttataatgaaagcgaatacaaagtagagaaaaatactttgaaagaagtgaattcattatgaaactgtttattaacattattttagtcttgattgttttagctggtcttggtggaatgatttatttatcgattgatggtgatcgtttcttaggcgcagctgggttagcgatgctttatttcattggatcaatcggctattttgttaactgttatacgattaaaaaacgtggtcgtatttagatagaaagggtcaaaagatcttttttattttcaagttttaatctatacgtgaatatgttttatgatgaatttatttatttaagctggttaatttagccagcttttttagttataaagggtattatatttacaaatactagtacttataagtttaaacataggaatagatgatgatataaaaataagagaagctcttcgaaaagaaagattggctcaacataaaacacaagccgcttggattaaaaatatacctatgtctgtttctcactattcagaaatagagacaggttatgctaaaaatggaaaagaagcagatattgatagtgaaaaattaattttacttcttaaatctaatcatgtagatataataagattttttgagtcagtcaatggctcgtacaaaattgatgaacgtgcaaggatgatagaggatatttctaatcaattatcaattgcttttaataataatgatttagaaagagtcgagaaaattactcatgaattggaaaatatgcctgctgttccaaaaattacatattatcgggctgtattaatcagggcttatttaaaggacgaaatgacttcaatggataaggcaactcgagcaaaaattaatcaatatatttatcaaaaagataattgggttacagataacgaggcattaacaatttttggtaactctatgcctatttctgatccaggcattttgatggctagaatgggaaaggtattacgctactataaaaatttagaaaattgtccagctacttttcaacggagagtatccacagtttgtgttaattatttatacacggcgctttgtattagaaaaattgataaatatgtgtcagaaacaatggctcttattcgtacattgccttttgatgataggtttggattaaagattcttattactcaatattttgaagatatgagaaatggagataaaaaatctatgcagcaattaaaagatgtgttgagacatgcaggtctaacgaaacttgcaaatcgattacagaatgaaagctgatataaaaataattcgaaatatcgaaatttaattgctgatgacggtactttcttagtaacatataatcaatctaaaataattaatcgataagtttagtgtaaggagagtaaatatgaagaaatttaaaataggagttatttcatttctgactgtactggtaatagcacttattggagttttgactgttcatacgtctgctaccgatcgtttaaatccgttggttagcgaaacagttagttatgctaaggttccaaaaagcactcagaattacaaacaagtaacgatcattaacccaaaggatagtaaaactagagcttataaaataaaacaagtaggtggttatgatccaaatcaggaatatattaagatccatcataagggtcaatatgtaaaatcaatttcatatattacaaaaaaacaattctataaccaacaataaaaatttttagctagcaggtcgctagcttttttctttttgttagaatataagcagaaattaaagaggaagatatatgttaactaaagagcaaaaagaaaaatacatgcacctagcctttgaacaggcaaaaaaggctgaagaacaaggtgaagtgccaattggtgcagttgttgtggataaagatggcaatgtgattggcgaaggatataatagacgcgagcttgatgaagatgcgacgcagcatgccgaaatgattgcaattagacaagcttgtaaaaatttaaattcctggcgcctagtcgactgcagtttatttattacgcttgaaccatgtccaatgtgcagcggggccatcattaattcaagattagctgaagtttattatggtgcttttgatccaaaagctggagcagcaagcagtgtcattgacttatttaaggtagaaaaatttaatcaccatcctaaaatttatggcggtttatttagggatcaagcagcccaaatgctaaaagattttttccgtgaaattagacgtaaacaaaagcaagataaatagtggaaaaataaatcaaaatactgtattatagtttgtgggcaatgtccgacctccaaattgtgtcaggaccggaaggtagcagcactaaggttgcttgggcatgtgcctttttttgagaatttaaacagctcttagctcgtttgagctaggagtttttttgataaaggaagtgcaaaatggcttatcaagcgctatatcgtaaatggcgtccgcgaacttttgatggagtcgtaggacaaacagcgattactgatacattaaaaaatgcaatcaagcgtggcaagatatcacatgcttttctattcgcaggaccacgtggtactggtaaaacatcatgtgctaaaatttttgccaaggccttaaattgtactaatctgcaagatggagaaccatgtaatgaatgtgaaaactgtcttgcagcagatcaaggaacaatgaacgatatcattgaaatcgatgccgcctctaacaatggtgttgatgaaattcgtgatatcagagataaagtaaaatatgccccaacacagggtaaatataaagtctacatcatcgatgaggttcatatgctttcgatgggtgccttcaatgccttacttaagacactggaagagccgccggagcatgtagtctttatcttagctacaacagagcttcaaaaggttccagcaactattatttctagaactcagcgctacaacttcaagcggattgatcaacacgatttaatcgctcgcatgacctatattcttggccaagaaaaaattgactttgaagaaaaggcccttgaagtaattgctcaagtagctgatggtggaatgcgtgacagtttaagtatcttggatcagattttatcttatgatcaagataaggttaaatacgaagatgctttaagaataactggttatgcagctcaagaaaaaattgaacaagtattattaaatttacttaatggcaaaacttcagcagctcttgaaatagttcatgcacttttgcaggacggagcatcaactaagaatattttagatgagttgattagtttaactgttaaagggatgctggcaattaagagtaataaggaagaaacttttttaactgagaattatgcttccgaattagctaaaattccagaagaaaaattctactcactcgtgcaagcggctaataaggccttaaatgacttgcgctacactaaccagcaacaaatcccgcttgatgtatttgtagttcaagtaactcaagctccagtaaaagctgatagtacacctcaacaagctgaagcaatttcgtcagatgttgttcaaactctaaaaaatcaaattgacactttaagcaagcaagttgcggaattgaaaaatagaccggtacctgctagaagtactacttcagacttttctggcacaattaaaactgaaactaagtcgcaaattaggcagcgtaatgaacaagaaaataaaccagaacaaaagccaaaaagaagaaaagctagttctaataaccaagcggctcaagaaaataaccgccggcaggtatatcatgtgcttgaaaatgccactaaggaagacctaaatacagtaaaagatatttggccagacttactgtctactctaaaagtatctcaaagagctgtaatggaagttttagatcctgtggctgcaagtcacgagcaaattgttttaaaatgtaagtatgaattatggtttgagcgagcaaatcaagatggagatctaatttctcaacttgaagctgaaattgcgaagctaacaaagcataattatagtattgttttagttgcagattcttcatggttgaaagtacgtcatgattttgtggcaagtcataaggaagagctacttgctaaaaaatttcaaagactagaaaaatctgaacaagaagcaaatggtaatcagatagatcctcaagcaaaaaaagaagtcattgataaggctaaagaattgtttggagatctagcacaagttaaagattaaggagagaaaaaagatgggtaagagacctaattttggtggtatgggcatgggtaacatgcaaggtttaattaagcaagctaagaagatgcaacaacaaatggaagctgaacaagcaaacttagctactcaagaatttgttggtaaggctgctgatgacatggtagtggctacttttagcggcgaccgcaagctaaaagacttgaagattaataaagaagcaatcgatccagatgatccagatatgcttcaagatcttgttatcgatgctgtaaacaagggaatcaaggcagtagatgatgctactcaagcatcaatgggcaaatacactaaaggtttgatgtaagatgcaatatccattaccaattgcccgtttaattgataattacatgaagctgcctggtattggtgaaaaaacagcaactcgcttagccttttacacaatggacatgccagaacaggacgtggaagacttttctaagtcattaatgcaggtaaaagaaaatcttcattcttgttctatttgtggaaatattactgaaagtgatccatgtgaaatttgccgcgattcaaaccgtgaccgctcaacgataatggtagttgagcaaccaaaagatgtcatggcttttgaggaaatgggcgaatataatggcttgtaccatgtcttacatggagtcttgtccccaatggatggagtaggcccagaagaaattaacattaaaagtttaattaccagacttcaaaaacaagatgaagttaaagaagttattcttgccctaaactccagcccagaaggtgaagcaactgctatgtatctggccaagctgattaagccagctggcttaaaggtaacgcgtcttgctgctggtttagccgtaggtagcgatattgaatacgccaactcaattactttgaagcgcgctgttcaagggagaacagatctatgattggaaaaaggaacaaagttaaaaaagcaggcgacgaacgattactaagaattgttgctcaactgcaaagacaacttgctgaacaaaaagttttcgatcaaacgacaattgattattcatttgataatcgagttttaaataaaattctccatgcaaaatttatttttttgtatgaagaagccagaagaagaaacactaaatctagtagctcatcaagcgctattactagataatgtagtccactgcggtggactttttttgtggaaaaataaataatcttgaaaaaacaagtctgtctttcttttttcttttacagtacaatgccaagtgggggtagacatgagaggatatttaattacatttgaaggcccagatggggcaggaaaaactacagttattaacgaaataattaagcaattaccgcaaagtttgcaagaacggactcttgtcacgcgtgagccaggtggatctaagatttcagaaaatatcagaacaattattttagatccagaaaataaagaaatggatgatcgaactgaggctttgctatatgcggcccaaagaagtcagcacgtaagtgaagtaattcgtccagccttagcaacgggtaaggtcgtcttatcagacagattcattgatagttcactcgcttatcaaggcgtaggtagaaatctaggcattgaagaagtaaagcaaattaatgatttcggaactggcggacttgagcctgatttaaccatcttcttagacctagatccagctgttggtttggctagaattgaaaaagagcgggctggtcaagaagatcgacttgaacaagaaaaaattgacttccataataaggtctatgctggctatcgtgaattatttgaacgctatcctgatcgaattaaaaaagtagatgctaatttgccgatcaaggatgttgcagctaatagtgttaaaataataagaaaacaattacctgatatttttatgtaaggatttggtaagaatgaaacttgttttagcaatcgtacaagataaagatgcagataccttagcaaaagaatttattcaaaatgatgttcgtgcaactaaattagctaccagcggtggctttttgagagcagggaatacaacttttatcgtgggtattgaagatgaccgcgtaaatgaagtattagaaatcattaaaaggagctcccatactagagaacaatatgtatcgaatatgaacatggatgctgcaggcacttccatgctgggaaaaccagtccaagttactgttggcggagcgactgtctttgtattaccagttgaggaatttaagcaattttaatgattgatttaaaaaatatcggccaaaagcaggctgatcttttaagggatgcatatttaaataaaaaagttgcccatagttacttgtttgtcgatcccatgcaaaagaagggaataaatacagcttactggctggcttgtctctttaattgtgtaggagaagataagccagacggaacttgtaacaattgtcagagaatcttagagggaaatcatcccgatgtcttcttagtaaaattagaaggtaagcaaactctctcaattgatcagattcgtcctttaaaagaagaacttgctaagagccctgttgaaggaaatcgccgcttttttataattgaaaatgcggaaaaattaactttggctgcaagcaacgccttgcttaatttattagaagaaccagtagcaccagtcgttaccattctgatcacaaataatgaaaatcaaattttaccaacggttaaatctagaacccagattcttaatttctctgatgaaaagattgacagtaaaagagcacaattacttgaatatggcttaacagatgaagaaattgatgatctaggcgacacaagtaagcttgaagaagagagcaagtacttgtttcaagaattattagaacgtaatgatttagccttggtgcgtgtgaatcagattagtagtcttgctactaagccagcgggtcaaaagtttgttttttatcagcttaagactttggcgatgaagagcttagaagctggtcaaaagttaagggaaagtgcatctttattagagttattaatgacttgcgataagatgcgagctagtaatgttagtttccacaatacattagattatttagtattgagttttgaacggtaggtgtttttgagtggatccattttcacaattgtcacaattacagcacaatcttcaggcgatgacaaaaactgttgccggtctggaaaatgacatgcttgaagtattgaaagaaaatacagaattaaaagttgaaaaccaactattaagagaaaagattagtaagctagatgcaaataaagaaccagctgagaataagtcacaagctggtttgaagtcactgagaaatatttacgattctggttaccatatctgcaatatgtactatgggtctcaccgtgaatcaggtgaagattgtatgttctgcttagatattttagataattttgtaaatcacggacaaaagagtaggggataaaaattatgcaagtgcagagtagttttaatgaaaaagataagggacgtctgtatcttgtccctactccaattggaaatttagaagatattactttaagagctaaaagaattctaactgaagctgattacattgcagcggaagatacccgaactagtggaatcttgcttgaaaagattggcgttcataataagatgatttcttttcataagtataattctaaagagcgtgctccagaattgattaagctgcttaaggaaggaaagacaattgctgagatttctgatgctggaatgccagtaatctcagatcctggttatgtcttggtgcaagaatgtatcaaaaatgatattcctgttgtctctcttcctggtccttcagcttttgcgactgccctaattgcttctggctttgatgcacaaccctttacttattatggttttttaccgcgtaagagcagtgagcaaaagaagtactttgaaatgatgaacacttcgcgtgctacttcaatcttttatgaagcaccgcatcgcttgaagaagaccttgaagactttagctgaagcaattaagccagatcgaaaaattgccttggctcgtgaattaactaagattcatgaagaatatatccgaggatcaatcagtgaaattaatgaatacttcactgagaatgatccacgaggtgaatttgtggttttagtttctccgaatgaagaggaagaaaagcaactttcttgggatgaactaattaagcaagtagccgatcaagtagcagctggtgaaagtaaaaaagatgcgattaagtcagttgctaaggcaaataaggtttcaaagaatgaactttatgacaaataccatcaaaattaagcacgaggattaagatggaaaagatttttaaagaagagcaccaagttagctatggtgattgtgatgaaacaggaaaaattcaacttcctcatttaattgagcattttatgcaggtttcaaatgatcaattaacagcaggtggtgctgggattcatgatttactaaagcaaaatctaggttgggttgtagttgagtatcatcttgatattgaccgcttgcctgaagctggtgaaaaaattactgttactaccaacggtagtggatataatcgcttttttgaatacagagattttggtataattgattctactaacaaaaagatagtgggcgtcaaaagccaatgggtaattttagatttgaaaaatcgtaaaattactgaagcagatgatcaaatgatgcagaaatttggaaatccatacttgaaacatatgccgcgctttaagagattacgtcccttaaaagaatatcgctcaagtaagaaatatactgttagatattatgatttagatacaaaccatcatttaactaatagtatttatttcgattggatgattgataccttgccaagagagttcttgaactctcatactgtcaaaagtattgatatttcatttaaaaaagaagttcaatacggagatcaagcactagcagaagtagagcttgaccaagatacattgacttcgtatcatttaatttctaatcagggtgaggcgtctgccttggctgaaattaattggaaagaaaattaaaggcatgacttgttgttagtactgtcgtgctttttttgaaaggtagggatgccaatgaaggcaggaataaagaaattagatttgcaggggttagttaccctggcactctttgtagcaatggatattgtgcttgagaagatatcttttggtccatcaaccttaaaggtaggattaggatttattggaagtgcattgcttgcttattatttcggtcccttgtggggcggaattggggcattagttagtgacttgttgcggtcagcgatttttggagttgagggaggcttcttcccgggctttacgctgtcagcaattgttggtgtggtaatttacgccctcttcttatatcaaaaaccaattaagtggtggcgtattattgcctcaaccttattagttaccttagtggttaatgtcttaatgaatacttactggattcatctattatatggcttagatttaagagcagcatttctacaaagaattctaaaagagttgatcactccttggattcaaattgtcgctctttacgtgattttaaatgctcttcaacgtgttaaaataagaaggtaatttcgataataataaggatagaatttaaatgaaaatattaagtattactactgcaaccaatcatttgagcgtagctttgaatgatggagataaaatttgggaaaagaacgaagaagatcatcgaaatcatagtgaacatttagatcctttaattaatgaattgttgaaggaaaacgatcttactttaaaagatattgatcgttttgcagttgcagaaggtcctggttcttatactggtttaagaattggaattactactgctaagatgtttgcttctattttaaataaggacttagttggagtatcaactttagctgcattggctaatggcgcaagcgatggcttaatcgtgagtgaattagatgctcgtaacaagaatttctttgctggtgtttatcgtaaggctgacggcaagttagagaatctagttcctgatggccactatcatttagatgacttgatgaataaggtaaaagagctcggcttatctgaacaagttatctttgttggtagctcaattgaaaaataccaagatgaaattaaggacttgctaggctcagataacttcactcaagatgtaggtgataaccaaattcatgctggtgaaattggaaaattagctcttaataaagaagcagtagatcctgataaaatggtgccaaaatatttgagacgtacacaagctgaaatggactggcataataagactggaaaggcatttggcccggatagcgactatgttgaagaagtttagtttattttttcatccggtagaaatcgacctcagctttacgccctttgcattaaggttagataatgaaacttatcagattatgaaggctagcgatgagaatattgcggacttattaggtctagagcaagaagtgtactttggacggacgccttggagtcgattctcttttaagagtgaattaaaaaagcatgctaattccttgtacttggtagtttatcagggttcgactttggtgggctttgtagggatgagaatgcaggctcaagaaggtcatattaccaatattgccgtgaaacctacctatcaaagaagaggaattggtgaattcttactgagaaccatgattgggattgctcagaaaaatcgcgcagttcagatgactttagaggtacgcagcgataactataatgctcagagtttatatcgtaagttaggctttaaggataactttattcggaagaactactatactactgaacaagcagatgcgattagcatgattaaggaattgacagattaagaataggaagagataaagtgactaaaaaagatgttcgaattttagcatttgaaagctcatgtgatgaaacttcaactgctgtgattaaaaatgggcgtgaaatcgaaagcttaattgtagctactcaaattaaaagtcaccaacgctttggtggggttgtgccagaggtagcaagtcgtcaccatattgaagtaattacgcagattactaaggaagctttagataaagcaaatgcgacttgggatgatattgatgcgattgccgtaacctatggacctggtcttgttggggctttgttaattggggttagtgcagcaaaggctgcttcaatggcaactggaattccgttaattggtgttgaccatattatgggacacattatggcagcgcaattaaaggatgagattgaatatccagcccttgctttgcaggtgtcaggtggacatactgagattgtcttgatgaaggatccgatccactttgaaattgtgggcgatacaagggatgatgcagctggtgaagcctatgataagatcggccgcgttttaggtgttaattacccagcaggtaagaccattgatgaatgggcacataaggggaaagataccttccacttcccgagagcaatgatggaagatgatgactatgacttctccttctcaggtcttaagagtgccttcattaatacttgccaccatgcagatcaaattcatgaagaacttgataagtatgacctagctgcaagcttccaggcttcagttgttgatgtgttaagccacaagacaattagagctattaaggaatataagccaaagacctttatcctaggcggcggggtcgccgcaaaccacggcttgcgtgaccgtttagcagaagaaattgagaagttgccggctgatattaagccgaaggtgatcttgccagacttgaagctttgcggtgataatgcagctatgattggtgcagctgcttataacttgtatcaagcaggtaaattcagtgatgtgaacttaaatgcagatccttcacttgagttgccatatgccgacagcatgttgaagtaagagctagacaaagcataatcgtaaatagttaatagaataagttattttataaagaaccaaatgatgttgaagaacaatgttttttcttcgatgtcgtttggtttttttgctttgttcgtaaaccaccttgacaaaataaaaaatggggggggtagactagaactgtatctaccttttagatcaaaaccagttatttaatttgtttggaggagtaagaatgaaaagtaaaaataacaagttaatgtatgtctccgctgcagtacttgctgctggtgcagtagctggcgttaatactcaaaacgctcatgcggctgaagttcaaaagcaagctgataagaatgcagcacaaaaaacaattgatcaaaatcaaaaagatttgactcaaactcaagatcaattaaccaaggctcaagcagagcatgatgatgctgttcgcaagacctcagatgctcaagcaaatgttttaactgctgattcaaataatcaatcagctcaaaatgtattagaaaatactcaagatcaattaaagactgctcaagatgcccaagctaaagctcaagcaaactatgatgcttcttatgaaaacaatgttaagtctgcacaaaacgatgtgaataaggctaacgctgatgttcagaccactcaagaacaaatcaatgttcaaaatactaaacaagcagaagctttaaatactcgtcaaggtcaagaagatgctttaaagactaatactgaaactttgaataagactaatgaagaaattagtaagactcaaggtcaagttgaacgagctcaaaagacttataatgatgtaaataaagactatcaaccagtcaaagcagaattagacaagcaaacaaaagaagtagaagatgctcaaaaggctgcacaagaaaatgctaaggaattaactcaagcacaaaacgatttaaagactgcacaagatactgcaaataaagcagtagaaactatcaataatgcacaagcaaaattaaataatgatactgaagcattaaacggtgcaaagatcgaattaagttcaaagcaaaaacaatctagtgacttaaccagccaaagagatcaagtagctaaagaattgcaagctgcacaaactaagatgaatactgcaaaagcagaattagatgctgataaagatgcagtagtcaacactatggttatgccacaagtctataaagatacagtaaagaagtggtcgactagagatcatactgatgattatgacaaagaaatggaagccgcaagttggattggctggacacaaaatgaatacaagcataatgaagccgaaaagaatcacatggtcgatttaaagcatatgtcaagagctgaccaaatcgaattgaataagtttggcattgatttgattaatcaattaagaacccaaattggtgtagatccatggacatttaatgaatcagctttagactttgcaaatgcgattgcagatagatatgtaaaagatgattgggattccgataaagatggtcatgatagtgccgcaattaatgaattagcacatcaatatggcttgcaatcaaagatgcatagagatggatcattcagcaagtctggtcaatactatgagaatatgatgactgatagattcgggcaaactgaagcaacatatgcgcaagctaagcgaatgaaggctgacggtagtactcaatcattacaagaattagcttataatgtcgcattatcgtataatcattcacaagacaattataataatcgattagatgatatggatcacctaaagaatcaagtatataacacagttaagagatttgcattcaattataatgaatggcttcatgcatatggtattttgtcacaagactttttcaattatagtgcaaaaggtaaaaactatgccgcaattagtttcaatgtgaagccaacaaaagataaatggggcttcgacgatatgcctattcacgtagttaatgttcatgaatctcaagtgttagatccaaaagtcttcaatgttaatgcaaatattcccttgaaggatgataagagcgcactgaaaaagcaatacactgataacttagttttagtaaacacattaactcctaagaaagctaacttagacaaccaaattaacggtttaactaacgatattaaaggacttaatactcgcatcagtgatttgactaagtcaattagtgatactaacaagagccttacagacgcaaaagcaactaaggcagatgcagataagaagattacagttctaccaggtcgcgttcaagaattgaaagataaacaagcatccctaaatgaagctcaatctaaagcagaggctgatttggctacttaccaagctaagaataaagatcttcttgctcaatttaacgctgctaaagctaacttagataagttaacggctaagctaaatgatcttaacagtgcaaagagcaaggctgaaagtgcagtagcagaaagcaaagtaaacttagacaaggcaacaagtgaattatcagctatttcctctcgtttagatgaattgaaagctaagttatcaactgctaaaactattaaagaacaagctgacgctaacttagctaaggctaaagctgcatatgatgaatatgtaagtacacataaagatgtaattgataacttgaataaggcaaatgctgaattagcagataagactaaagcttataacgaagcaaaagaagatgctgctaagactgataaggaataccaagctgctcaagatgaattgactaagttaaacaatcatattgaagacttatcaacagtaattactaactatgaatctaagatcaagcaattaaatactacaatcaacaagcaaaaggcagaccaaaagcgtgctgctcttgatgctcaaattaataaggctctagataatgtttcagctcctaagcaagctgccactacaactactggtgttcaagctggcacttctagctctgtagcttcagtaggtgctgtatctactactcaaagaagtgaagtcttaactaacactgtagtaagatcaaatactgcatctgttttaagccctcaaactaagaagttagttgcccaagctaatgcatctaagaattcattaccacaaactggtgccaacgataagcttagtgtatttgctgctttagcaggattgtctttagcatccctaggcctaggctctttagtaggcgataagaagagaaagcgtaactaagccgatggaagaaaaagaagttctaaaaaagcttggctttaaagacgaagcatcattacaacaagtagatcagttaaagaattatgagcttaactacgtcgatgaccactttgatctggtagaaaagaataaggcagcagtacagaattctgtgaatcgcttatccaatgctcagcaatttatgccaattttctattacagtgtttatggtcgagtaattataagtggttggcgtgcacttttaaatattaattctaatgacttaaataagaatgagactaagagtaaatcagatttacgtcataaccaatcatggattagtgcaaaatctgatgagaataatgtttcatctattgatagactaatgcttggtaaaaaagcgacagttttaatagatgaaaaagagcaagaagctggtttaagtagattaaaagttgatcgaggtcatatcttaggaaagtttagcaatttgctttcacaaattgagcaattcttaggtgatgaacaaaatgtcaataacgttgatatttaccctcaatttaagcgtgcaaatgaaaatgctaaaaatgatcatggtcagttatactttgaacatttaattggaaaacataaggatactccaatttactatgaggcagaagctatcttcgctaattttgatgataaggttcctatcggaacaagaattaaaattgtcaaaattgaaaaagaaaatactaaatatatcatagcacctaatgaagatgaaatttctttccacgtcttcattcctaactgtgactacgcagaaaaagatccaaaatcagttttgaaatctgaaaacacggtagatgattatcgcaccttctttaaaggaggtaatttaaacagtctaaaatggaaataggctgttaactccaaagaataaataaataacagtttgattttttaattagggtgaaagctctaatccacttatcttttattttatttttacataaaatatcgtttaacatttttcatcgaaaacaagcaactgaaatggttgcttgttttttttgtgtttaataacaaaaaagaccttattctgcctataaataaggattattgttataataagaagtgaaagatcaataatcttgaggaggaaaatttattatgaaagatgaagttcaagctccacaagaggaaactcctaacacatattggcgttggctggtagagtcatggcgctatcctctcggccacaacctaggggaaaagtggtacggagtcgttaccttattaggtgaagatattgtattattcattggtttagctattactagtaattatattgctaatatgtttgatattacgctgatccatcacgcatcaggttttaccttctgggcaatcgtaattctgttctgtattcaaattattacgattctttgttccatggttggtcacctgttcgtgttcggtagtaccggcggcttttggcagtatgtcaacaaggttgcacaagtaactaactggaacttctggattgtaatttgtgcattcttcttcttaatcctaagcttaagttcaggcttgcttggatttggggaagccttagtttggatcttctatgcactgttttctttaggttcattcttactggttgtttgtcctgatccaggaactgaaaagatgatccacgatccattctggggtgcagtaatttacttagtaatgattgttgtaatctatgccattatttggggcctagccttcagcattatgatcaacttgtagaaatattaaacaaaaaagatgtcgtttaatcaacgcgtagtacgaagattaacgacatcttttttgttgtgagggttatttgtcagttgtatttttaacgtttgggagcatataacttctgaaaatccatttgaattcttaaggcctcgtagattggttttccacctaagagatctaaaacgaaataagcaataaaagttgccacgagcattggaaagatctgttcaactgagccaaccatttctgttagcagggttaaagcagtaaagggtgctttttcaatagcaccaaagtaagcacacatggaggtaacaataataatgccatagcaacgctttggagcaattccggagtgaatcataatcacggcgaagataacacctagtaaggctcctaaaacaagaattggcataaaaataccaccaggaactgaggcaccatatgagatcattgaaaaaataaagcgaacaataaaccaaataagtggcaacaaagttaaacttagcatcccagtttggatatttttcataaaggttggttcaaaaagaccagagataaaatcgtgagaaccgccaagcagcttcgcattccaaaggccaattggaattactaagattagcggaataatactgtggtagattttagggatgatagtaagttttgaataaatgggtttaaggcttaagaggcagtattggtagaaataagcaagtaagcccaaaagacctcccattaagattacaaaccaataagaagttaaaggtaaagacctatctaagggaagataaaggcagggagtagtgccaaaaaagcataatgtcattaggtcagatgtcattgcagcagctagagcagttaggcattctttcggatcaaaactaaaggttatttcttctactaagaagaagaccccagctaatggagctgagaaagctgcacttaagccagcagcaatcccgcatccctggagtctcttaagatcttcatcatcggcatgaaaaagattctgaccaaaagcttgtccaaccatagcgcccatttgaatacaaggaccttctcgtccaagaaaaagtcccggacaaattgctaaaagccccccaacaaacttacgccacaagatgctccaccaattcattttattttcatcaagcattatggcttcaacttgaggaacacctgaaccagtaatattgttgaggactggtttaataacttgagcaagaatcagacaaattatcacggtcccaagcaggtaaggaacaagatagatcggcttttgacgcattaaaggatagataaaaaatagaaatttcattgtgtggtcaataatccatcggaaagtcccaacaattaggccagtaattaatccaatgataattccttgcaaaaagataaagaaaaaatttgatgtaaatggtttggctaaaacttgtttggccgttttaatcattttctgccagctttctaaaggttgtgataagcctagtttacatcaaattaataagcccaaaataaaaataacgatagcgttttactatcgttatttctgagtattaatattttgtggtctatcttagttttattacttatctccatcaaagatagaagatttaacaataacatagtctactactctgattgcacttagatcttttccaccagcataagaaattgaagactgtagatcttcttgcatctcacgtaaggtatctttaattgagccgcggtatggaactaacatttgcttaccttcgacattgcggtaggcgcctttttgaacttcagaagctgaaccccagtattgtttataacgcttaccatcaatagtaattaagttaccaggagattcttcatgaccagcaaaaagtgagccaatcataaccatagaggcaccgaagcgaacagacttagcaatatcaccattatggcgaattccgccatcggcaattaaaggctttctagctgctttagaacacattctaagcgctgctaattgccagccaccagtaccaaaaccggtcttaagctttgtaatgcaggctctaccaggtcccacaccaaccttagttgcgtcagctccagcattttctaattcacgaactgcttcaggagtagcaatattaccagccgttaagaaggtatcaggtaatttttccttaatatacttgatcattttaatgacatagtcggaatgaccatgtgccacatcaattgttgtatattctggaataatattttccttagcaagatagtcgatgaagtcgtattcgctatccttaattccaactgaaattgaagcaaataatcccttatcgtgcatcatcttaatgaagtcagcgcgtttttctgggtaaaaacggtgcataacataatagtagccatgttctgcaagccagatggctaaatcttcgtcgataacactttccatgtttgcaggaacaactgggattttaaatgttcgacttccaaatttaactcctgtatcagcctcgctgcggctcttaataatacatttattaggtacaagttggatgtcatcataatcgaaagcttccatactaaaataattgctcatttaatttacctcgtgctctttaaaaactacatgagttaatatacgggtgaagttagtcaaagtcaagaataaaaatgaatatttattttattgattattaaaaatgttcggaaatcaattgactattaagatatagattgttaaactagtcttcggttttaagaaaatgatttttatgaggtgaaatcaaatgacagcaatagcagttgtaggtagtcaatggggcgacgaaggaaagggtaaaattaccgatttcttaagtaaagaagcagcaatggctgttcgttcaaatggtggtaataatgccggccatacaattgaaatcggtgataagactttcaaaatgcgcctaattccatctggaatttttgctgctaagaagggtgctgtaattggtaatggtgtagttatcaatccagaagtaatgttcggagaattagataaccttgaaaaagaaggtatcgacattagcggcttgaagatttctaaccgcgcacacattattatgccttaccacattttgcaagatacttatcaagaagaagcaaagggtgacaagaagatcggaactaccaagaatggtatcggtccttgttacatggataaggcttcaagaactggtatccgtgtttgcgatttacttgaaagagatacttttgaagagaagttacgtactaatttagctgaaaagaatgctttattcactaaggtttacggtaagcctgaacttaaatttgaagacatctttgaaaagtaccttgaatacggtcaaaagatgaagaaatacgttactgatacctcagtagttgtaaacgatgctttagataacgacgaaaaagttctttttgaaggtgcacaaggagtaatgcttgatattgatgaaggtacttatccatacgtaacttcttcaaacactatttcaggtgggattgcttctggtatcggaatgggtgctaaccgcttagatactgttattggtgtctgcaaggcttacactactcgtgttggtgaaggaccattcccaactgaattattagatgaagttggtgatcgcattcgtgaaactgctcatgaatacggtactgttactggtcgtccacgtcgtgtcggttggtttgattcagttgctcttcgtcacgctaagcgtgttgctggtatcaacgctttaagtttgaacttattagatgtcttttctggttttgacaagattaagattgccactgcttacgaacttgatggtgaaaagatcgactactacccagcaagtttgaaggaattatacagatgtaagccagtttatgaagaacttcctgcatgggaagaagatattaccaatgtaaagacttgggaagatttaccagaaaatgctaagaagttcttgaaccgcgtttctgaattagtaggtgttcctctagttactgtttcagttggtcctgaccgtgaacaaactattgttttgaagaatccttgggaaaaataatttatgttagaacgttatactcgtccagaaatgggcaaaatttggtccttagaaaataaatacgctgcttggttaaaggtagaaatcgctgcaactaacacatgggcagaacttggtgaagtgccagaagcagatgctaagaagattgcagacaatgcttcttttactgttgagcgtgtttcagaacttgaagccattacccaccatgatgtggttgcttttacgagaacagtttctgaaagtttaggtgaagagaagaagtgggttcacttcggcttaacttcaactgatgttgtggatactgcacaaggttatatcttaaagcaagctaatgagatcattttgaaagacttagaggctttaaaagaaactattgccgaaaaagctaagaagtacaaatacactgttgaaatgggccgtactcacggtgttcaagcagaaccaactacttttggtttgaagcttgctcgctggtatgctgagattaaccgtgatattgaacgctttaaagcagcagctaaagatgtagaatctggtaagatttctggtgccgttggtacttttgcaaatgtgccaccagcagttgaaactagcgttttaaagcagttaggtttaactcagcaacctgtaactagtcaagttttaccaagagatttacatgcgtactacattgctacaattgccttaattgcaaccagtattgaaaattgggctactgaaattcgtggtttgcaaagaagtgaaattcatgaagttgaagaacactttagagctggccaaaagggctcttctgcaatgcctcataagcataatccaattggttctgaaaacttatgcgggatggcgagagtaatgcgtggctacatggtaccagcttatgaagatgtagctttatggcatgaaagagatatttctcattcaagtgctgaacgtgtaattttacctgatgcaaccattggaattgactacatgttgaaccgtttcaaccgcatcttaaccaacttagatgttttcccagaaacaatgctcaagaatatggatcgtacttatggcttgatctattcacaacgtgtgcttttgaagttaattgatgaagcaggtttatcacgtgaaaaggcttatgatatggtgcaaaagctagctaataagtcttggcaagaacaaacttcatttagaaagttaattgaagacagtgaagttatgaattacttgtctgaagaagatctagacgatgcttttgattatcattatcacttgaagcatgttgatgaaatttttgaaaagtgcggcttagattaagatagaaataaagacgttttgttagatataattgtgtctgacaaggcgttttttgtttgggataaggggaagtatgaagaaagaaattttaaagaaactggaatatttaaataagctctatagaaatgggtattggggaagtgaactaccagaagatacgcgtcctaaaaagttagatcctaattctgaagaaaatgctatcttctatactttaccaacagctctggattatcaaagaaattccaataccttatggaaaagtgctacagcaacttttgaaaataatgaaactaagtttgtatttaatccaggagaagtagtaaagaaagagtttactgaagtgcaagatgccttgactaaatataatttggctttgcagaaaaataagcaaacacaaatttggattaggttgtgtcagactttagttaataactttaatggaagagtaacggatttttttgcctattttgataatgacattcaaaaggtacggcactacatgcaggttgaaaagaaaaaagattttccgtacttatcaggtaaaaaattgtgcaattattggctatatgtgatgtatcaatatacgaatttacctttgattaacactgataaaatttatattgcaactgatcgacatattattagagctacacatcggttaggactaattacagatgaagaattagagagttcaaaagtacaagattatgtaatagaggcttggattgaagctttaaacgatacagaatatgtacccattgattttcaggctgctctttggctatgggcaagaagtggattcaaggaagatttgtagtagaaaaggatagcaactatgaaacaagaatactctgcaggcgctattatctggcgtaaaaataatgaagaaatccaatatttactaattcaaagtcaaccttataaacaattcaagagtgcttgggcattttctaagggacatcttgaagcaggtgagacagaacgggatgctgcaaggagggaagtctttgaagaagtaggattaaagcctgaatttgattttgattttcacgagagttattcatacaaggtcactagcgaaattgaaaagacagtaactctatttttagcagaatataaagctggtcaaaaaataaagcggcaagaaagtgaaattagatcgactgaatggttaaattatagagatgcgcaagatagaattagaaaacagaactttaaagaatttaaatttgaagatttatcagcaattttggctaaggctaatacttatttgcttgaacatgaataaaaagtcgttttgattgaacgactttttatttttgctaaaattaaaactttttatatagataaatgaatttgaatagaatgttaatgaatttgaatataaatagaggcttaatgataagaactatatagtacttataaaacaaaaacggagatgagaaaaaatgatgatagatatagtgctaatcctaataatatttggcattattttgttaataagtaaaaaacggccacaacgaatttggctcttgttagcaattatttttataggatttagtatagcaaattttatgttagtctacttttcaaaagataattgggatttagctttatatgcaatcagtttttatagtttgatttttggtttaatatttttaattatttttttagttaaaagaaggaataaaaaataatgaaaataaaaaattatcttgtcattgcagctgctagtttaggattatctttaatttattctaatcaggttcaagcggatgaaatgccaccaactaatcaacaatcagtaaataataatctatctcaaactgatataaatgaattagataaatatgttagtgtagaaaataatacatttgtactaaatgttcctgaaaattctaatatttcttctgaaaaagtacaaatggcacgacaagaaattgagagtgtaaacaatagtattaaaaataataatcttttaaaggaaaaatatatctttctgatatgtagaaaattcgtattcttctacatatttctatgttttgtatagcagtagcatggcaattagaatcatataataatactcatagaaatagtaaaatttatatggatattaattgggcctatgtcccttcgtttggaacgtggtaaaaagagaggatgaaaataatcatcctcttttctattgaaaaaatagatgatatcctaagatttattttagaaagtttgagtagttataatgtttgctattttcacttatttgctatttctattttcctatagttatcagttattaatattttatgaattaaatcagtatagactaggtagtataaaggatatactaaaaattataataattttagtgattagtataattattctagattttataattgggcaagctatttttttgattttagtaatatttttttatagtaagaaaagccagttaagtaaaatagttagtacaattttatttgctaatttgattacttatgcggctgatttgtttatacgattaattggactgtcatttccaataattacatcgtattttgtgccaatagcagttacttattatgttttggtttattttttaattaaaagagtaaaattataccaattattcattaaagaaaaaaactatcttcttcttggattaattgtttatgcatttatagcgctccatataattggcttaataagtatgaaagcaaatcaagatttaactggaattttaattactgcgctccttttatttattcaatttttgtttatgatatatgcattctatattcagaataagttatttgatagacgattagaggatagacttaataaagaaagagaaaataacctcaagtcatatttgaaaaacttagaatatagtgaagaaaaattacgtagatttaaacatgattatcgaaatatgttaataagcttacgtaatgctattaaagaagataataatgatatattaattaataagttagacagatattcagaaaatgaattagatcaagaaaattttgaagaatacaaagatttgataagagtaaaggatctgcaagttaaaagtattttgattagcaaaataaatgaaattgatagaaataatataaaatttagttttgaatgtgccactaagattgataatttagataaactagttaatccttttgatttaagtagaattattggaattgcttttgataatgcaattgaagaaagtaaaaataatcaaattggtgaaataaatgcatatatatttcaaaatggaaaaacatttacttttgagattagaaataaaataaaaaatattcctcaactgtctaaaattcaacaaactggtttttctactaagaagaatcatcaaggattaggactttcaaatattaatcaattaaaacaaaaatatcctacattatttgtaaattatcgaataaataataattggtttatttttactttaaatatagttggagtagatgaatagatgagaacttttaaaatcgctatttgtgaagatgatagagatcaaaatgaacatatcaattatatgattaaaaaatcatgtatatttttatctagtgaacatcaaaaatttgagataagtaacactttttattcctatgagtcaatatttcagtttattaattctagctctaaacttcctgacatttattttttagatattcaattgagttcgaaaccagatgataaaaatggaattgaattagcaaatttaatacgtaacaagcagaagaccgcacagattatatttataactactcatgatgaattagccttattaacttttgaatatcaaatagaagcattggattatattgtaaaaagtaatgaagaagctaaaattcaaactaaaataacacaagatttagaaaaatcagcttataaattagaagaatttcttgaaaagaaaaataatatttttacttatcaaataggtaataatttttatagagtaaatacagacgacatttattatatttctactacgccgtttccgcatagattgaaaattattgctaaaaatgagattagtgaatttacgggtgatattaagaatatacaagataaaatacccggttttattaaagtttctcaatcttatttagttaatatgaaaaatattacaagtataaatttgaagaagagattgattctctttcctactggtgaagaaattcaatttgcatttagtgcaaaaagaaaaattaaagaatatttgatggctgattaataatttaggggtgtgcgataagataaaaataaaaaagggtcaaattccatatttaatgtcttaagttaatgatattactatttggataggatgactttttgtttttgctatttttaactaaaataaatttgaagacagatattacagaaagtgtaagtaaaaatgtcagaaccaaattatccacatctagataaaaataagccttatccgttagctggaatcttggtaatagattttacccatgtcttatccggtccaacttgtagtagaatgctcgccgatgctggagctcgcgttatccatgttgaaagagaaactggcgatgatacacgtcacatgggaccttatcttgttgacggttctagtgaatactttagaatttgcaatactggtaaagaatcgattgccttagatttaaagaacgcccaagatcatgctttggcagaaaagatgattgctaaagctgatgtagtagttgagaatttccgtcctggcgtaatgactcgtttaggttttgatcctgaagaaatggtcaaaaagtatcctaaattgatttttgcttcaatttcaggctttggacaatacggtccttttgaagcaggtgagacagaacgggatgctgcaaggagggaagtctttgaagaagtaggattaaagcctaaatttgattttgattttcaggagagttattcatacaaggtcactagcgaaattgaaaaaacagtaactctatttttagcaaaatataaagctgatcaaaaaataaaacgtcaagaaagtgaaattaggtcgactgactggttaaattatcaagctgctcaagaaagaattagtaagcaaaactttaaggaatttagatctgaagacttgtcagcaattttggctaaggctaatgattatttggtgagtcgtgagggatagaaggaaacacaagttttgaaaaattagacagaaacttaggattgtttttaaaccagagagatggaggcattaacaaccaaaagtaactaattaacatgagtcaaattaatcatctaggtaaagaattcagttttctgaattctttttttgttataaaattaacaaaaaataaataaaagcaaataaggagatgagattatgaaaattggacaggcgttaaaagaagaacgtcaaaaattaggcttaactcaggaacagatgataaagggtattattagcaagggtcattattcaaaaatagagcgtggattagaaagtatttcaattgatactttatttagaattattttgaaacaccatattgatatcagtgatttttttaataaagttaagtatgattactatacgtctgaagataaaaaagctgaagaattgaagcaaaagatgttgcatgcttttaataacaatcaaagggaaaaagtaggaatttatttaaatgaaatcctagatttaaaagagcatcaactttttaaatatcgaacaataattgctattgcttctttagaaaatagcttatctgacttaagtttagcctttaaaaataaaatagttactagattttcagaacatgaaaattgggtggaaaatatcggtgcattacaattattttctgattatatgaagatattttctttagagcaagtagactattttcttggtcaattattaaaacattatcaaaagaattcttgttctgagagtatgagggaaagagtagcaattatttgtaataattatctttgttattgctataagcaaaaattaaacggagataatattgaagctgcattagattatttagcgagcttagaaacgactactcattttttgctttatcgaatttgtcatgagttatattttaatttatttagtgggaatacagaaaaagcagctcaaataaaaaaattgctgatgaaatgtggatatcaagaatgtatggaatattggcaaatttagttgtgtatagcacaacataatgaataaaaactgaaaaagctgtgataattataaacaacaaatgataaaaataaatttattatttgtgtaaatatttctagataggaaaagtgagctatgaaaaataaaaaactatttgtggctacttttgtagcattattgcttttcgttggtggaggagtatggttttatcataatcagaccacggttcctgaggaatgggttggtcaaagcctaatgactttagaaaaagaagataataggttaagtaattctttttatttaatgtttgataaaaatactgcttatattgccacacgcttaggtggcaatgaagagagcaggtcatcaaaattaagtaaagatattttaaatgccttttcgaagaatggaaatactcgaccacaagctggtgaatgggtgaaattaggacgggttaaaactgagcgattgaaagatggctataaaattaaaacaaggaaagtaacctttgattttaaaaaggcttctaatggagcataccaaagtcaagatggtacttattggcaatttgtccctaaaaaggtggtggaaaataaacaataaaaatggacattagcgatattaatattaaccgtatacaaaaatatgcctgattagaccaagatagatctaattaggcatattttttatgtttaattattgtttccagctagcatcaaatttttgcttggcagtctgaatagctggattaatatttttcttctttttagcatcagctaagattgcttgcatacttgcttgaacttggtcataagcaggtgtggcattcttagttactggtaagaagtacaagtctttagtagtctcagccaagattgctggtactttacttgtattaagtgacttgtaagcttgtgagtttaggacttgcgtattaactggtatatagccggtagttttagtccagtagaattgttctttcttactggttaagaattttagatacttgaaggcagctgacttttgtctagcgctagcctggttaaacatataaatatcagttccttgttgcgcattaaccttgcttggacgaggggcaatgccaaattgatattctttcttcaagccttgttttagatatgcttcattagcagttgaaccgataaacattgctaccttaccagaattaaatggggtagacatatatttttcagtaccagcttgcatgaagtagcccttacgaaccccatcagcgtagtagtcaattacttcttttgaatctttaccagaaaagttaatcttcttagtaaagttgatgcctttttccttcatccccaacatatagtaattgtttaaagcatcaaaaccagccccagttacttgatggtcactcttttgatagatcttttcagaagcagacttaagctcgcccattgtttgcggaactttgagattatattgatctagtaaagtcttattatagaaaagtacttcaactgacttattaaatgggactccgtattgagtattgttaatttttgcgccgttccaaagtgcttgcttaatattacttttagcataggagccccagccaaggtcatcatttttaacataaggagtgaggtcaactagcattttttgcttagcggcattatacaaccatcctggataagcctgggtgatagtcggcaaattatcaggtgattgcattgttgaggaaagcttagactgaagatccgcataattaccgccttggctttcaagcttgatcttgatttttggattttctttttcaaagtccgcagtcatcttcttgagggctttttcagaagaaccggttaatgaataccaaaaagttaccgtagtattcttggtaatcttagtcggaattttgctactagactccttagtttgagtcttagagcatccaactgctaaaagtgccgttccaattgcggcaagagttaacatcttttttctaaatttcatttttcttctcccgtcaattcattttgacaggtactattttaacatgaatttaaaattagccgaaaatttttaaaataataaaaaaccatccctcatcggatggtcaaaaattattcaaattcatctagtgcttctaaagcattttcccagtcagtatttgcttgatttagttgctcttgaacagcagataatttttcttgaagaggtccaagcttttcaaaagaagcagcaatatctggattagccatttcagtttgaatctcttgttcttcattttctaatttttcaattctagcttctgcatcactaacagcgcgttctaacttacgtttttgtgaatcatgagccttttgctcttgataggaaagtttaccctgattttgattagcactagtagtactttcagtttgttcagcttttgcttcttgaacagcagcagcttgtttagctttttcatctaagtagtaagaataattaccattgtagatcttagcgtgaccatcgcgaactgaaataatcttattagctaactcgttaataaagtaacggtcgtgagaaacaaagagcaatgtgccatcataattatctaaagcttgttcaagcacttcttttgcttcaatatctaagtggttagttggctcgtccattagcaagaagttgtctttttcaagagacaaaacagttaaggttaaacgagctttttgtccaccagataattggccaactgtcttatcaatatcttcagcagtaaataagaaggaagctaagattgagcgaacgtctttttctggcatggtcttgtgacgatcccaaatggtatcaagaactgtctttgaaggatcaaggctttgaagttcttggtcgtagtaaccaatatctaagctagcaccatacttaattgaaccatccttaggttcaagttttttcataattgttttaagtagggtagacttaccaattccgtttggtccgataattgcaacacggtcatttttattaacttgaaaatcaatgtcagaaaccattgttttatctggataaccgatagttaagtctttggcaattaagacttcttttcctgaaggacggtcactagtaaagttaatacgaactttttgcttgtgcttaggtggcttaattcgctccatcttgtctaaagccttacgtctactctgagcacgtttagtagtcgaagcacgaactaagttcttttgaatgaactcttcttcttttttgattttttcttgttgcttctcataagcagcttcttgctggttattcatcaattcacgttctttaacgtattggctatagttacccttaaaagtagttagttttccaaagtttaattcaaagatttggttagctaagtgatctaagaagtattggtcgtgagaaacagtgataattgcgccttgatagttcttcaaaaatgcttctaaccaatctaaagtatctaagtcaagatagttagtaggttcgtctagcaagagaactggtggcttttgcaacagtaatttcacaaaagcaaggcgtgttttttcaccaccagaaagagttccaatgactttctgccaggtattttctttaaaattgaaaccattaagaatactcttaatttcagcttgataagtaaagccgccttcttgttcaaagtcgtatgcaagctggtcatagcgcttgagcaggtcttcatcttcaggatgttcagcaatttgttcctgcattttggtaatgcgtttatttttttcaattaaattatcaaacacagtaagcatttcatcccagatagtcttgttttcatcaagggcattttcctgggcaatgtagccgacttttaatcccttattaatggtaaattggccgctagttggttcttgctgaccagtcataatctttaataaggtagtttttccagctccgttaggaccaaccagaccaattctggcattatcaggaacagaaaaagaaatgttactgaaaatagtattgcctccaaaacgttgttcgaggtcttgagcttgtgcaataatcataataattttctcctagagcttattttaacatagcaaatgttttaaattttatgaaaatattatctttgtgaaaattgtttcttgatttatccttgaagaatgcctattattagtttgattagtaaatatttcacatttttattttatgaaagaaagaggcctctcatggatgaaattaagattcctaaggctaccgctagacgcttgccactttattaccgctatttgatatttttgaatgatgaaggaaaagaaaaagtatcttcaactgaacttgctgaagctgttcaggtagacagtgcttcaattcgtcgagacttttcttattttggtgctttaggtaagcgtggatacggttatgacgttaagaacttacttaatttctttaaaaagattttaaatcaagataccttgaccaatgttgccttggttggtgttggtaacatgggtcatgcgcttttaaattataactttaagcgtactaataatatcagaattagtgccgcttttgacattaatcctgaaattactgggacaattatgtcaggtgtgcccgtttatgacatgagtgagatgaagaagcaattgcgtgaacaacagattaccattgctattctctgtgttccccaaactgccgcccaaaagacagctaatgaaatgtttgatgctggaattaagggaattatgaacttcacgccgcttcgtttatctgctccatctagtgttcgggttcaaaatgttgacttagcaactgaactgcaaactttaatttactttttggactcagataaagataagaacaaaaaataatttactataatatagtccttttgcacaagtttaggtaggcttgtgtattttttatgcgcttttatttgtaattaaagagaaaataattttaagatagatgagcgtagaaaaattaatgagatagaaatcaggtagataaaatgattaaaaaacttgcagtatactgtggtgccagggctggtaatcgtcctgaatacattaaggctgcctataattttggtaagaaaatggccgaccaccaaattgaattagtttatggtggcggaaagttcggcttaatgcgggcagttgcagacggtgttttagaaaatggtggtatcgtccacggcattattactgaagaattaaaagatcgcggagcttcttatgataaagtacaggatttccgtgtggttcccaatatggataagcgaaaagataccatgatgaatctagcagatggaatggtagctttacctggaagtattggaactttagaagaaataagtcaggctatttcttggactgcaattggtgacaatgctaagcccgtagctttttataattatgaaggtttctatgattatttagataaactccttaagcggatgaatcaagatgattttttagagaatatctatttagacgcaatttattttggaactgattttgataaaattctacagtttatggaagactatcaagcacctgcttatcggaagtattaataaaagatcgactaaagtagagaaaaagtatgaaattaagactgttttaggcgctcaagtagaagatattattgaaaaagatgcaccagattgcattttaattggaccgcaaattaaatacatggaagatcaacttaaggcggatgcaaataagcacgatatacccttagaagcaattgggatgcaagattatggcacaatgaatggtaaaaatgtaattgcccaagctgagcgattactaggataaaaactggtagaagtatgaaacaaaatccctctcttgattcatacttctttttttgaccacttagaactataaaatgaccgcttagttaacttcactagattttaatcttacattcatgtttaatataattatcgaaaatgaaacaaggaagtgagaattgtgaaagttaagcttgaacttgatccggatcagaaggaaacagaaataaccattcatgctggtcagttaacacctgaaatagaaagaatttatcaacaacttcaaatggattcagatcatcctgaccaaattgaaggaatgatggacaacacttcctactatttaagtattaatgatattttgttttttgaaacagatgctaagcaagtaatggcgcacacgactaggaatgcatattttgttaaatataaattatatgaattagaaaacttattaggtggacagttcatgcgaatatcaaaatcgacaattttaaatttagatcagatttatgctattactaaatcgatctctaattgtcagattaaatttcatgattcatataagacagtctatgtttctagacgatattatcgagatttaaatgatagattaaaagagagaagggcattatcatgagaaaggccagttttggaaggattctttggggcttaggcctgcttgcagcagcagcgtttttagtgttagaccagttgcatttaattccagtagagttaggattctggacaattttttggactgtagtatttgcggcaacattaattacttccttaattaatagaagtttaggtggaacaattttttcaattgcatttttattaattatctatgcaaagcctcttcacattgaaagtattgttccttggacagtgcttttagcagcatttttagtttggggaggtttaagattaatcttcaaaaaaagttggaagccaactgtaattattaatggtgaaaaagtcagtactaattggtctgacttaaaggcacctcataaatttaaggctgaacatgtattttctgatacaacaagttcagataatggtgacaatattgtaattagcgaaaaaatgtcttctacttcacgttatgttcattcacagcatttagagacagtaacgataaatgtttcaatgggagacgttaatgtctatcttgattcagcaaaaccagctggggatgaagtgattgctaacgtgaatatgtcaatgggagatttaaccttctacattccaacgtcttggcgggtggataatcaattaaatcaaggattcaatgatattactattgatggtgatcaaccagcagagggtccaaccttagtgcttcaaggccgcgccaatatgggagatattactgttaagagagtttaatatattattgtttcaatttaaataaaaaagaagtaaactattatagcaaaaaagagagttactggtaatagctctcaaatcacaagccgctaaaatgcggtggcaagattaataacaaactaaaagtcgctatcaactccgccaaaagttatcaagcggctttttagtttgctctattttctcttccacaaatcgtggatagtctttactagtttctctatagcttttacaagcttttgtgcattgtttactagttttattaaagctagaaattgaacttataaatgtaatgctgtaaactatttatagcataaaaaagagagctactaccaatagctctctcaaatcacaagccgctaaaagtgcggtggcaaatattgatgcaaacaaaaaagtcgctagcaactctgccaaaagttattgagcggctttttcatttgctctattttctcttccacaaatcgtggatagactttatcagtctttttacagcttgcgccaacttgtctgcatcgcttactagttttattaaagctagaacaatacagtctaagaaaccaataaaggcaaggacagctccaaaaatggctgtcatgaagcaaattgtacctcctttcagtaagaatctgtacaatagtaattacaccattggcatcatctcctcaaacgaaagtaccaccgcatatttaactttttgtgcgtgtttaattttatcaaaaattaccaaaattaatctacatttatgagtaaattagcactttttagcactctgatgataaaagtgctaatttttgcgtctaaatacttgcttttcttttataaacaatgtactatcgtaattgtaagttagcacttataatatatgagtgctaagtaatataattatagatttaaattatgtacaggagggactaacgtgttacaaccaatcggtgatcgcgtgatcgttaaagtaaaagacgaagaagaagaaaaagttggaggcattgtcctggcttctaacgctaaagaaaagcctcaaatgggcgaaattattgccgtaggaaatggtaagcgcaacgcaaatggcgacttaattcctatgtcagttgcaaaaggtgaaactgtattctttgataaatactctggcactaacttgaagtacgaaggcgaaaagtacttagttcttcgtgaaagcgacttattagctgtcgttaagtaataaaatttgaaataaaaggtggcatataatatggctaaagagattaaattttctgaaaatgcaagacactcattattaaaaggtgttgataaattagcagatactgttaagacaactttaggacctaagggtagaaatgttgttttggaaaagagttatggtgctcctgacattactaacgatggtgttactatcgccaagagtattgaattagaaaaccattttgaaaatatgggtgcaaagcttgtttctgaagctgcacaaaagactaacgacattgctggtgacggtactactactgctactgttttaactcaagcaatcgttcgtgaaggtatgaagaacgttactgctggtgcaaaccctgttggtattcgtcgcggtattgaaactgctactaaggcagctgttgacgaattacacaagattagccacaaggtaagtactaaggacgaaattgctcaagttgcttctgtttcatcagcttcaactgaagttggtaacttaatcgctgacgcaatggaaaaagttggtcacgatggtgttattactatcgaagaatcaaagggtattgatactgaactttcagtagttgaaggtatgcaattcgatcgtggttacttatcacaatacatggtaactgacaatgacaagatggaagcagacttagacaacccttacattttgattactgacaagaagatttctaacattcaagatatcttgccattattacaagaaatcgttcaacaaggtaagagcttattaatcattgctgatgatgttgatggtgaagctcttccaactcttgttttgaacaagatccgtggtacgttcaacgttgttgctgttaaggctcctggctttggtgaccgtcgtaaggcaatgcttgaagatatcgctatcttaactggtggtactgtaatttcttcagacttaggtcttgaattaaaggacactaagattgatcaattaggtaaggctggcaaagttactgtaaccaaggattcaactactattgttgaaggtgctggttctaaggaagctattgcagaacgtgtagaccaaatcaagaagcaaattgctgacactacttcagactttgaccgtgaaaaattacaagaacgtcttgctaaacttgctggtggtgttgctgtcatcaaggttggtgctgctactgaaaccgaattaaaggaaagaaagtacagaatcgaagacgctttgaacgcaacccgtgctgctgttgaagaaggttacgttgctggtggtggtactgcattagttgatgttatgaagtccatccaaggcactgttaagggtgacagcgaagacgcagaaactggtgttaagattgttatgaaagctttaggcgctcctgtacgtcaaattgctgaaaacgctggtaaagatggtgctgttatcttagatcacttagaacatgaagacccagaagttggttacaatgctgcaactaacaagtgggaaaacatggttaaggctggtattatcgacccaactaaggtaactcgttcagcacttcaaaatgctgcttcaattgctgccttgttattaactactgaagctgttgttgctgacgctccagaagatgacaagaaccaagctcctgcagctccaaacccaggtatgggtatgggaatgtaatttagaaactaattacatttactaatttaataaattgataaaacactccatgatttttgatgatcatggagtgtttttgtgtagtagagtataatatcttaataaaaaattacagtttaattttttattaagaaagaagatgacagtgatgaccattggcgaagctttaaaagaaactagaaaaaatctaggattatctcaaactgagatggcgtatcctattctgacaaaatcatattattctaaaattgagcggggaatccacgagattaatgccagtgatttaattaagattttagaaatgcatgatgttgatattagtaaatttctagtaaaatgcgggttaaggataatagaattgataaagaatattggggagagcagctaagccaggcctactatgatcaagacttgaataaggttaaagaactagaattagaaataccaaatattaaaacagataactatactaaagatcttttaaaatcaatgattattctgaataaggcaaatttacaggggagtatagataccttacctgatgaaataaaaaaacatgttaaatctctaattttcaaagcagaaaattggaataaagaaaatctcagtttattctcaattagtcttcctttatggtcagatcaagaaatgaaaccaatagtaacatctcttttgaaaaaatatgttaatattgaaaactttccacgagagatgcaaattttagtctcttcaataatggttaattatctgtccctattgattagatcatcatcacaaaatttagacttagtagaagatatattcattttattagacaatttaccagtaaaaccattaaattgctttggaaaaataatgaaaaatttttatcgagcatattttcaaggcgatgaggaaaaaatacaggatatcctagacttttttactaacaacgatatgaataaaatttctgaaattttaaaggtgtcaatttagacactttttattttgcactaaagatgtgagtaaaatgataaatataaaaaataattgcctggaaatataatcattttcataatcagatttatatggatttgaattggaacatgacatatagttttcatattttacaataatggaatgagttacgtatgaataatcaatttcaattttatcttataatactatcaataatcgtaagttttattctctattatattattcgaccaagaattccaattttatacgaagcgttagtatgtacgtatgtaactctattttgtctgtatttagtaatacaaggagaatacatactattaatcggtgtagttatttttactgtattatctatttactattggaaaaaatattatactaaaaaaagtaactaattctttaaataggaaattctatattaattaacacattattaataaaaaatggatttatatagtataatctaataaaaatattaaataaggaggatcaaattatgccgacagtagtattaaatgctcatcaaaatttacaagacaataaataggtgagcggagaataattacaattcattttgttgaatccgttcatcaaggaggacaaaatgaatcacgttaaaaaattaaatcagtacttcaaagaattagctagaacttatcatttattctttaaatcagcacctctaattgcgacttgcgttttattattagcacccttgcaagcggtagttctgttaattgccgtagcagctggacaaaaggtaattgatcaagttactaatcattcaccctttatggaaatgatcattgtatggattgtagcgactgcgtttcaacagtttttaccatctttatcaacaatggtgcagggaattttaactgataaattaacaggtttcattaacattagtttgatgaaaaaatctgaagatttacagtcaattaggatttttgacgacagtaaatactttgatgatttacaaatgcttcgagatgatgcaagctggcgtccagttaatttgattgtttttggagtatcagttttgcagtcgtttctaacgttagcttttatgttagtgtacttggctcgctataattggtggctggcgcttttattattagttgtaatggtgccgcaaagtatttcttattaccgtattcagcagcaatcatttgagacaatggttgaaagaagcaagaatgctagatacttacattactatagtagtttgttgttagaccgcagggatgctaaagaagttcgactttttaatatgtttcctaaaattactgaaaagtatacgaccttatttgaacagactaaaagggatgtaaatcaaattcgtaaaaagcaactcgctgttagttcattatttgttcttctaactgttggagtggttggttacggtttttattggtttactaactcggtgagaactggtgctctagaagttggcgttttgttaatgtttgtttctgtaattggttatatttccacaagtatggcacgagtagtggaagatagcagtctactctatgattccttactgtggattgaaaagtactttaattttcttgaatatcacgatgattttaaaaatggaaagcaagaatttcctgatgagtttaagaagattgaagttaaggatctttcatttacatacccattttctgatgatgaagttttacacaaggttagtttttcagtaaatagtggtgaaaagatcgcaattgttggtgaaaatggatcaggaaaatctactttagtaaagttgttaatgcgattttatgacccgactactggagctatttcgattgatgatgataatttaaaagattttaatatttttgacctacataaaaatttatcagctacttttcaagatttttctcgttttaagttaacgcttaaagaaaatgtgattacgggatattcatttaataaagaccgagtaaataatgttttaaaagcagcaggcctagagaatttgctggctaatgatcatctgcaactaagcacgattcttgctaaagattttgaaaaggggactgacttatctggtggccaatggcagaagattgctttagcacgagacttatacgcaaatggtaaaattgagtttttagatgaaccaacagcagcgttagatgctaagagtgaagcagaaatttatgagcgatttttaagagaaaacaatcaaaagacgatcttctttgttacgcacagactatctgcagttaagtttgctgataaagtactctttcttgatagtgggaaagttagcggctttgatactcatgctaatttattgaataaaaatgcaaaatatcaagaaatgtataacttacagaaaaatgcatatatttaatgttagaaaattcttcatgcaagcaggcatggagaatttttttgcgcctcaagagttaacatttttaagtgatttttacgttataatagaacataggtttttggaagaaaggatatttggtaacgaatggcaaaaaaagatacgacaccgatgatgaagcaatattacgaaattaaggaacaatatcccgatgcgtttttgttttatcgtgtgggtgatttctatgaattatttgaagatgatgcaatcaaaggcgcacaaattcttgaattaaccctaactcatcgttcaaataaaactaaaaatccaattccaatggcaggcgtgcctcatctagctgtggatacttacgttaatactttagtagaaaaaggctataaagtagcactttgtgaacaacttgaagatcccaaaaaagctaaagggatggttaaacgcggaattattcaattaattacgccaggtaccatgatgcaagagcggccagatcaagcaaaagacagcaactatttaacttctgttatttctacaaattctggcttcggtttagcctacagtgacttatccactggggaaactttttccactcatctagctgactttgaagcagtagcaaacgaattattgtcacttcaaacacgagaagttgtgtataacggccacttaactgacttaaataaggactttttgaagaaggctaacattactgtttctgaacctgttgaagttgaaggtgaacatgcagaaatttcttacgtagctcagaatttaactgatgacgctgaaattaaagctactaagcaattagttgcatatcttctttcaacccaaaagcgtagcttagcccacttgcaagttgctcaaagctacgaaccaacgcaatacttgcagatgtctcacacggttcaaactaacttagagttaattaagtcagctaaaacatctaagaagatgggttctttattttggcttttagataagactagtactgccatgggtggacggttattaaaatcttggattgagcgaccacttctttcagttacagaaattacgcgtcgtcaggaaatggttcaagcccttcttgatgattactttacccgtgaaaaagttatcgacagcttaaaaggtgtgtatgacttagaacgattaactggccgaattgcctttggttcagttaatgctcgtgaaatgctccaattagcgcattctttaggcgcaattcctgaaattttgaatgcactgcttgaaacaaataatccacatctgcaaaattttgcaaaacagatcgacccactaaaaggaattcatgacctaattgtcaacactattgtcgataatccaccgcttccaacgactgaaggtggattaattagagagggcgtttcagaacaattagaccgctaccgggatgccatgaataatggtaagaagtggctatctgaaatggagagtcatgaacgtgaagtgactggaattaataatctaaaagttggttataacaaagtctttggctactatattgaagttacaaattcgaataagagcaaggtgccaactgatcgctacactagaaagcagaccctaactaatgcagaacgttacattacgcctgacttaaaggaacatgaagctttaattttagaagctgaagcaaaatcaactggtctagaatatgatttatttgtaaagctgagagaagatgttaaaaagtacatccctgccttgcaaaaactagctaaacaaatcgcaagtctagatgttttaactaattttgcgacagttagtgaacaaaataattatgttcgtcctaactttgtgactgataagcaagaaattaatgtagttaatggacgccacccagttgttgaacaagtcatgactgcaggtagttatattccaaatgacgtgaagatggatcaagatactaatattttcttgattactggaccaaatatgtctggtaaatcaacctatatgcgtcagatggctttaattgcaatcatggcgcagattggttcttttgttccagctgatagtgcaaccttaccaatttttgaccaaatttttactcgaattggtgcagcagatgatttgatttctggccagagtacttttatggtagaaatgagcgaagcaaacgacgctttgcaacatgcaactaagcggtcgctagttttgtttgatgaaattggccgaggtacagctacttatgatggaatggcacttgctggtgcaattgttaagtaccttcatgacaaagttggcgcaaaggccttgtttgctacacactaccatgaattaaccgatttagatcaaacgctcaagcatttgaagaatattcatgtaggagcaacagaagaaaatggaaagttaattttcttacacaagattcttccaggacctgccgatcaatcttatggtattcatgttgctcaattagcaggtttaccacacaaggttttgcgtgaagcaacaacaatgcttaagcggttagaaaagcaaggcgctagtgaactgcaaccagctagtgaacaacttgatctctttgttcctgaagaagcgagtgcaccagcaatttcagatgatgaaaaagatgtattagatgagattcaaaatgtgtatcttgctgacaagacacccctccaagttatggaattagtggctcagtggcagcaggaattgaaagataaggactgagaatcatgagtaaaattcatgaactgtcgcctgaactaactaatcagattgcagctggtgaagttattgaaagaccagcgagtgttgtaaaagaattatgtgaaaattctcttgatgcaggaagcaagcgaatcagaattgactttattgatgctgggttaaagcaaattacagttcaagataatggtagcggaattgctaaagatcaaattgatttagcctttactcgtcacgcaactagtaagattgcgactgaacgagacctatttaatatttctactttaggatttcgcggagaagctttagcctcaattgcagctgtttctcatgtagaagtaacgacaagtaatgataatttaggtggcgtacgggcaattttttcaggtagtgaaaagaagcttcaagaggatgcagcttcgcctaaaggaaccaaaattacagttagcgacttattctttaatacgccagctcgtttaaaatatttgcgctctgaaagaactgaaattttaaagattgttgatattgttaaccgtttagctttaggacatccagacgtttcgtttaccttaactaataatggcaaagtcttgttaaagaccaatgggcgtgatgatttaaggcaagacatagctaatatttatggtcggcagcttgctgaaaaaatgaacatccttaagggaaagagcccagactttgagattagcggcttaatttctgatcctaatactactcggtcgaaccgcaactttatttccttattattaaatggacgctatatcaaaaactaccggttaacccaagcaattatggctggctatggcaataaattaagaccgcgtcgttatccgattgcagtagtaaagattgaacttgaccctcttttagttgatgtcaatgttcacccaactaagcaagaagtgcgtttgtcaaaggaacaagagttagagcgtctgttaactactagtatttctgaagctttagaacaaaataatcagattgattcagggttaaataatttattagcgcctaaaaaatcaactaatattgatcaattgaaattcaacttaaataaagatgtagttaatactgctcgtcctgttgaatttactccgcaagttgaacctgaccaaaacgctgaagtgcatgaaactggtgctaattttgttagcttagaccaggtgcgtaatgatgataaatatgtgattacgtcaacgtggaatgacaacgtaaatcaacaagtacaattgagtccttttgatgaagaaaaggatatgcaaggaaaagatgatagtattatctcatctggagatgaaattttagctaataatctacctgaattgacttatatgggacaaactaagtcttacttgattgctcaccatgaggaagatctgtatttaattgatcaggttaacgcatatcgccgtttagcttatgatcaaattcttcaagatttaaatagtgaaaatatttctcagcaaggtcttcttagtcccttaattttggactttagcaatgttgattatttgaaattaaaagaaaatctagaaaatcttcaagaatttggcttatttttagaagattttggtcaaaatagcctgatcttgagaacatatcctatgtggcttcagcccgatgctgaaaaaaatgtccggatgattttggacttatatttaaatcaaactgagcatgatatttctaagcttaaagcgcaaattgctggcgaaataactatgcgtcaaagtgctagaagaagaatgctcaatccagttgaagcacaagagttgttaaaagaattaagaaatagtagtgatccttatcaagattttgaaggaaaaataattattatccagttaagcgaaaatgatcttaacaagatgtttaaaaaagatgagtaggtaaaatgtttgaatatctcaagggaatagtaacaaaaattgatccagcttatatcgttctagatgtaaacggagttggctataagattctttgtcccactccttatagttatgatgaaaatcaacctgcaacaatttacgttgagcaagttgtaagagataccggaattactttgtatggttttttgtctttagaagataaagaattatttttaaaattattaagtgtttcaggaattggacctaagtctgctgtggcaattatggctgctgaagatactgattctttggctagtgcaattcaaaatggtgaagtaaaatacctgactcgtttcccgggagtaggaaaaaagactgcttcccagattgtcttagacttgaagggaaaactaggcgactatgtaaaaaaatcaactgctgctgccgatcttactccaagtctgcaagatgctttacttgccttagtagcacttggttatacccaaaaagaagttgatcgaattacgccaaaattagcaaaattacctgaaaacactgctgatggttatgttaaggaagcattggctttactacttaagaaataaaatttagaaattaattgatgatagggaagtgaaagatgtgaacgaggaagaacgaattataggagcagaaagtagtgaagaagatgaaacaatcgaattatcgctgcgtccgcaactacttgctcaatatattggacaagataaagttaagagcgagatgaaaatatacattaaagcagcaaaacaacgtgatgaagctttagatcatgttcttttgtatggacctcctggattaggtaagactactttggcttttgtaattgctaatgaaatgggggttcatttaaagagtacatccggaccagcaattgaaaaggctggagacttagtagcgctgctttcagaattgaatccgggggatgttctattcattgatgagatccaccgtttagcaaaacccgtggaagaagttctctattcagcaatggaagatttttatatcgacattgttgttggagaaggtcaaacaacacatgcagtccatgtaccgctacctccttttaccttaattggggcaaccactagagcgggtcaactgtctgcgccgctaagagatcgttttggaattattgaacatatgcagtactattctgttgaagatttggaaaaaataattcaaagatctagtgtagtctttaatacaaagattgatcctgaagcagcaattgaattagcacgtcgctctcgtggcacgcctcgtgttgctaaccgcttgcttaaacgtgtgcgtgattttgctgaagtaaagggtgaagaagctatttcgttagtaacaactaagcactcacttcatttattagaagttgacgatgaaggactagaccagacggaccggaagcttttaagaatgatgattgaaaactatggcggaggtccagttgggattaagacaattgcagctaatgtaggggaagatacagatacaattgaagaagtatatgaaccgtacttactgcaaaaaggttttattactcgaactcctcgaggcagaagcgttacacaaaaagcttatctgcaattaggttatccaccaaaagatgaaaagtaagtttttagttaagctaaaaatacggtataattattacttgaaagttaattaataaaaacaatgaggtgtaatactttgaatacatttttcttagcacaaagtgctgccggtatgaataatatttttatgatcattgcaatgattgcaatttttgttttcttctatttctcaatgatcaagccacaaaaaaagcaacaacaagaacgtatgaagatgatgtctgaacttaagaagggcgaccaagtaattatggttgatggtcttcatggtaaagttgattcaattaatgatagtgataagactgtcgttattgatgcggacggaatctttttaacatttgaaagaatggctattcgtcgtgttcttccaactgctgcagctcctgcacaagaccttaagtctaatgaagctaaagaagaaaaagttgaaactgaagaaaagactgttgaaaaagacagtaagccagaagaaaaagctactgatacaactgaaaacactaattcagaagataaataaagaacgtccgcaaggacgttttttatttttttattgtcatgactagtattgtaaaatagaattggtaaagttgatttttattaagtaggtagttagaatgaaaaatattccagttgttatgattatttttggtggctccggagatttagctcatagaaagctttatccagccttatttaatttgtatcaaaaaggtttaattcatgatcattttgctgtaattggtacagcgagaagaccttggagccatgaatatttgcaagaacaagtagttgaagcagttaaagaaagctgtgacaactttgatgaaaaagaagcaaaagaattcgcttcacatttttattaccagtctcacgatgtaactgatattggccactacattgccttgaaggaattagcagctaaacttgatgaaaaatatcaagcagaaggaaatcgaattttctacatggctatggcaccaagattttttggtacaattgctactcacattaatgatcaaaaattgcttggtagcggctttaaccgtttagtaattgaaaagccatttggtcatgatttagcttcagcagaaaagttaaaccgagaaattggcgaaagttttgatgaagagtcggtatatcgaattgaccactatcttggaaaagaaatggttcaaaatattatgcctctaagaatgactaatccaattgttaagaatatctggaataatgactatatcgcaaatatgcaagtaactttagcagaaagtctaggagtaggaactcgtggtggttactacgaaacatctggtgctttacgtgatatggttcaaaaccatatttttcaaattattacacttttagctatgcctgagcctaaaggacttgattcagaccatattcaccaagctaaacaagaattattagatagtctagtaattccaactccagaaatggttaaaaagcatttctcacgaggacaatatttagctgatgataatgaagtagagtatttaaaggcagatcaagttgcactagactctaaagtagaaacatttgtagctggagaagttaaattcaaaaagggtccagtagctgatgtgccaatttactttagaactggtaagaaaatgaaggataaggtttctcgcattgatattgttcttcaccatatgaataatttatacggtagcgcacattcaaataatatctcaattattattgatccaattagtgaaatttatttcacaattaatggaaagaagattacagctgaaggtttaagaagagaaaaccttagttataagttttctaaggaagaaatggagcaagttccagatggctacgaacgattgcttcacgatgtgtttgtagcagatagaactaactttactcactggtcagaattgaagcaatattggaagttcgttgatgcagttgaagatgtttggcaagatgaaaataaagatgttaagcagcttgaacaatatccaagtggtaagttcggtacggaatcaagtaatcatatttttgaaaaagatagcgagcactggatttaccgttaatggatttactgcctaaaaacaatacgagtcgtaagattattcatattgatatggatgccttctatgcttcagtagaaatgcgcgataatccatcaattagaaataaagccgtcttaattggtggagatccgaagaaaaataagggtcatggggttgtagcgacggcgaattatattgctcggagctatggagctcattcagcgatgccgacggctaaggcggtaagattaataccagcagagaagttggtaattattcaaccaaattttgaaaaatatcgtgctgtatcagctgaaattcatcaattgatgcataagataactgatcgggtagaatctgttgcgttagatgaagcatatttagatgttactgaaaataagcttaatttaaccgatccagttcgtattgctgctttacttcaggaacgaatctatcaaagaattggtttgactagttcatttggtgtctcttataacaagtttttagctaagatgggctcagaatatgccaagccttttgggagaactgtaattaaaccagaaggtgctcgcgattttttagcaaaacaaccaataaagaacttcccgggtattggaccaaagactcaagaaaaactggcagagatggaggtttataccggagctgatctaagaaaaattccaaccgatattttaattaaaaaatttaatcgaatgggttatcttatggctcagcatgctcatggtattgacttaagagatgtagtgactgattcggaaagaaatcgaaaatcaattgggattgaacgtacttttaatcaaaatttatttgatgaaaatactgccttaacaaaattgcggtcatatagtagagaacttgaaaaaagtttaaaggagcgccactttcttgcaaattgtgttgtcttaaaagtacgcgatgctaattttaagacaattactaaaagaaggaagctaaagcagggcactaatgataaaattgttatctacgatactgggcgtgctttgtttgcgacagaaaaaagcatgctttcaactggaatccgacttttaggccttacggtcactgattttgaagagcatcccgttgagaatatatcgctagaaatttttgataatgagtaatgataaaataaaaagaaaaatttaggagagagaattaatggcaacttttgatgaaatttatgaaaagataaaagaatatccaacaattattttgcaccgtcatactagcccagatccagacgcaattggttctcaagctggtttggctagatctttgagactagctttccctgataaaaagatcctttgtgctggtgaaaatgatgaaggtgacttaatttggattaacaagatggatgaggttaagccagaagactacaagggtgctttagttattacaaccgatactgcaaacactcctcgtatttctaacaaaaattatgacaaaggtgatcttttaattaagattgaccaccacccagatgtagatccatacgcagatatgagctacgttgatccagatgcaccagctgcttctgaaattatttttgatttcttaaaagcagaaaacttaccaattactaaggaagttgcagcagctttatatgcaggtattgtaggtgatacgggaagatttatgtatcctgaaacttcagctcatacttttgatgttgcagctgaattaactaaaactggaattaatattacggatattgctagagaaattgcggatgttacttttgatgaagcaaaattacaagctttagcaatggataagatggagattgatccagttggggctgcttatacaattttgatgcaagatgatttgaagaagatggggttaactgacgatcaagcaaatgttgctgtttcaactcctggtcgaattaaagatgttttagcttggaatgtatttgtagaaaagccagatggaactttccgcgttcattatcgttcaaagggacctgttattaaccatttagctgaacagcacgatggtggaggtcatgccctagcatctggagctaatgcaaaagacatggatgaagtaaaacaagtctttaatgaagtagtagaagtaacaaagaagtataaagaagaacatggcacaaacaagtagtatatttcaaaatgaaaaaatccggccagaactacaagccggattagaaaaaattaattttaagaaaccgactaaagtacagtcttcggttattccggcatttttaaataaaaagaatgttgtagtgcaagctgcaacgggatcaggaaagactcatgcttatttgattccaattttgaatatgattgatgagagcgcacctgtaacacaagcaattgttactgcaccgagtcgtgaattggctaatcaattgtataaagttgcgcgtcagttaagggatgctagtggtttaaatatttcaattgaatatttaggcggtggaaatgaccgtaatcgccaaattgaaaaggctgaaagcagagccccacaattaattattgcaacccctggtcgtttacatgattttgcatccaaaaaatttattaacttggagaatgtaaaggcctttattattgatgaagctgacatgactttagacatgggctttttaggtcaaatggatgaaattatgtctaagttggacaaaaaagcagtcttaggtgcattttcagctacaatcccagttaagctcgaaaactttttaagaaagtacatgtcaaagccagaatttatcgttattgacaatccggcaattattgcgccaacgattcaaaatgatttaattgacgtaggttcaagagacaagaaatcaattttgtataagttattaacaatgggacagccatatttagcccttgtttttgctaatacgaaaaagactgttgatgaattaacggactaccttgaagaacaaggccttaaagtagcaaaaattcatggtggaattactgaacgcgaacgaaagagaattattcgtcaagttagagagggacaatatcaatacgttgtagctagtgacttagctgctcgtggaattgatgtacccggtgttagcttagttgttaactatgaaattccaaaagatttagaatttgtaattcaccgaattggtcgaacaggtagaaacgggcttgaaggacatgctattaccttaatctatgatgatgaaatgagtcagattgaggacttagaaaaattgggtattcattttgactttaaagatcttagaaatggtgaattagttgaaagaactcactatcacagaagagataatcgtcaaacgcgtaaccataaacttgataaccgcatgatcggtatggttaagaaaaccaagaaaaaagtaaagccaggctacaagaagaagattaaacaggccattcaaaaagatcgtcagcaaaaacgtaagcttgaagaacgtcatcaaattcgaaaagcaaagcgtaaacgtaagcgtgaacgtgagcaagcacgtagtaattttgacaactagaaaatttgtagtaaaataaagcacgtttaggacatattattaaagtatttttttcaaagagaggactgcttggtgagaaggtctagaaaatatttagtaatgctacctaagttaattagagaaataaatatttaaagaggtaacaaacactgttgcaatcaaggtggtaccgcgctgggagcgtccttgttttatgcaatagtgttttttatatttgtaggagaactttttatgaaacaattgactagttcacaagtacgtcaaatgttcttggacttttttaaagagcatggccacatggttatgcaaagtgcatcattaattccacaagatgatccaaccttgttatggattaactctggtgttgctacaatgaagaaatactttgatggttcggttgtgcctaagaatcaccgaattacttcttctcaaaaatcaattagaactaacgatattgagaatgttggtaaaaccgctcgtcaccaaactttctttgaaatgcttggtaacttctcagttggggattactttaaaaaagaagttattccttgggcttgggaatttttgactagtccaaaatggttaggtcttgatccagataaactttatgtaactgtttaccctaaggatactgaagcataccacatgtggcatgatgttgttggtttacctgaagatcatattgttaagttagaagataacttctgggatattggtgaaggtccatgtggtcctgactcagaaattttctacgatcgtggtcaagaaaataacgatgtggctgaagatgatccagaaaacttcccaggtggagaaaacgcgcgctaccttgaaatttggaatatcgtattttcacaatttaaccacttaccaaatggtaaatatgttgaccaaccacataaaaacattgataccggtatgggattagaacgtgtagtatcaattattcaagatgctccaactaacttcgaaactgacttattcatgccaatcattaaggaaactgaaaagttaagtgatggcaagaagtatgccgcaaataaagaagatgatgttgcatttaagattattgctgaccatgttcgtgctgtaagctttgcgattgctgacggtgcacttccttcaaactcaggacgtggatatgttttacgtcgtttaattagacgtgctgacttaaacggtcaacgtttaggtattaaaggtgcattcttgtacaaattagtacctgtagttggcgaaattatgaagagccactatccagaagttgttgaccaacaagcattcattcaaaaagtaattaagaacgaagaagaaagattccaagtaactctttcatctggtctaaacttacttgataatatcattgctgaagctaagaagagcgatgataagactatttctggtaaagatgccttcaagttattcgatacttacggcttcccatatgaattaacttttgaagctgctcaagatgcaggtcttaagattgataaaaagggctttgatgaagaaatgaaagctcaaaaggaacgtgctcgtaaagctcgtggtaacttgcaatcaatgggttcacaagatgttactttgatgaatatcaaagataagagtgaatttgaatacggcactttagaagaaaaacatgccaaattaattgatattgttgttgatgacaagttagttgataaggcagatggtgaacatgcaactttaatctttgataaaactccattttacgcagagcgtggtggacaagttgctgaccacggtgaaattttgaaccaaaatggtgaattagttgctcgtgtaactgatgtacaacatgcaccaaatgatcaaaacttgcactttgtagatgttattttgccacttgaaaagggacaagagtatgtcttgaaagttgatcaaaaacgtcgtcgcggcttaaagcataaccatactgctactcacttattgcatgcagctttacgtgaagttttaggtactcatactcaccaagctggctctttagttgaaccagattacttacgttttgactttacaagcttagagccaatgactaagaaagaaattgctagtgttgaaaagttagttaacgaaaagatttgggaagaaattccagtcaagaccactgttactgacccagatactggtttaaagatgggcgccttagcattatttggtgaaaaatatggtgacacagttcgtgttgttcaaatcgatgacttctccactgaattttgtggtggtacacactgtgaaaatactgatcaaatcggaatgcttaagattgtttctgagtctgctgttggcgctggtactcgtagaattattgctgttaccggtccagaagcttacaagtatgtaacagaccgtgacgaaatcttgaaagaagttcaagatgaagttaaggcaactaaggctgaagatgtagttaataagatttcttctatcgaagatgatttacgtgcaagccaaaaagaagctgaacaattaaaggctcaaattaataaggcaaaagctggcgatctctttaatgacattaagcaagttaaagatttaactgtaattgctgcgcaagctgatgttgaaggcatgaatgatttacgtgaacttgctgacaactggaagagcagcaataaatctgatgttttagtcttagctgctgaagtgaatggtaaagctaatatggtaattagcttagatgataaggctattaaagcaggacttaaggctggcgatttgattaaaactgctgctccaatctttggtggtggcggtggtggccgtccaaatatggcacaagccggtggtaagaatccagcaggattaaaagatgctatcgctaaagtgttacaagaagttgaagaaaaacaaaattaattgagttcgttcgatatttcaagtaaaattaagaagaataggaggaattttattatgagttcgctagataaaacaatgcattttgactttaaccaaaataagggtaagaatgtatacgatactctacaagacgtatacaatgcacttgaggaaaagggctatagcccaattaatcaaattgttggttacttactttcaggcgaccctgcatatattcctcggcataatgatgcacgtaatttgatcttgaaacatgagcgtgatgaaattattgaggaattggttaagagttatttaggtaaaaataaataatgcgattacttggacttgatgttggctctaaaacggtcggtgttgcaatcagtgaccctttgggaattaccgctcaagagcttgaaacaattaagattgacgaaagtaagtttagctttggtctgcgtcagattagaagaattgtacgtaaatatgatgttgaaggctttgttttaggtttacctaaaaacatggatggtagtagtggacattcggtagaaagaagtaaacagtatggtgagcgcttgaaagaaaagtttgacctacctgtttattacatggatgaacgccttacaacggtgcaagctgatcgaattttagttgaagaagctggcgtccatgatcgtgttgaacgaaaaaaagttattgaccaaatggctgctgttttaatcttgcaaaactatttagaagcaaccagaaaggataattaaaatgagtgaaaaaattaacgctaaccaagataatgatcgtcaaattactttagttgacgaacaaggtaatgaagaattatttgaaatcttatttacttttacatctgaagattatggtaaatcttacgttttactatatccagcagctgttagtgacgatgatgatgttgaagtacaagctttcagctatgatgcagatgcagatggcgatgtaactagttctgacttacatgaaatcacagatgatgatgagtggaacatggtacaaggagttttaaatacatttttgtcagacgatcgcttaagcggcgaataatcttcaaaaaagactggcgattgaagctagtcttttttgcttaatcaaggatgagcaatgatttcttttttcattttattaatttttatctattgttgttatgtaggctatcggcgtggtgtagtatatgaaggcttagcagctggtggatatgtaatcgggctaattttagccactttattgtataaaccatttagtaactttttaaatttgtgggttccatatccatccgcaaatgatcgaagcagctttgctttttttgataagactacgggattaaccttagataaatcattttatgcagcaattgctttttcaattattttgttgattgtttgttgcttatggcgttttgtgatgctagggtttaatcaattaagatatgttacggtaaactctaacctaaatctctggggaagtttaattatttcttttattgtgacacagattagtgtttatttgcttttgtttattttagccacaattcctaatgatggtttgcaaaatatgctggggcattctattttagcaagtggtatcttgcatttttctcctggaatttcccaattttttataaatttattcattacaacaatataaaaatggccccaactctggggcctttttgctaggtggaatatatgaactctaaaattattgaaaaattagaatataatcgcataattaaacaattaagtgatttggctattacagtacctgcaaaagagcaggctttaacgttaatgccaagtagtaattttgatgaagtaaaaaaatcaattgatcaaactagggtcctttctaatgttttacgagttaaaggaccaatgccgataactgactttaaagatgttagagctagtttgaagcgtttgaaggtcaaggcaaatttaaatggtgaagaattaggtaatatttttctaattcttagcttagctaaagatgtttctcagtttactgctgacttagaagagcgtgaaattgatacccgtccgattgaaaaaactcttaaaaatttagcaattccagaagacttatttaagaagttgaatcaggcaattgaatatgacggaactgttaaggatacagcttcttctaagttaatgcagctgcgacatgatattcaaagcaatgaaactgatattaaaaatcacatgaatgattacatcagtggaaagcatacacagtatttgtcagaaaatatcgtaactatcagagatggtcgctatgtattacctgtaaaacaagaatataagaataaattcggtggagttgttcatgatcaaagtgctagtggacagactttatttgttgagccacaagcagttttagttcttaataaccgacagcaaaatttaatggctcaagagcgtcaggaaatccaccgtatcttaattgaattgtcagaacttgctggtatgtatcaaaaagaaataaaaaataatgcggatgcattaacacaattagactttttaagtgctaaaagcaaattagctaaagcaatgaaagctacagaaccagtattaaatcaagatcatgtcattaagttgagaaaggctcgacacccattaattgatcctaaaaaagttgttcctaataatattgaattaggaactagctttgataccatgctgattacgggacctaacacaggtggtaagacaatcacgctgaagactttagggctgctccaattgatggctcaagcgggattattcatcacagctgaagaaggcagtcaattaactgtttttaatgaaatttacgccgatattggggatgagcaatctattgaacagtcattaagtactttctcatcacatatggaccaaattataaaaataatgaaagatgtaactgaggatgatttggttttaattgatgaattgggagccggaactgatcctgaagaaggagctagtctagcgatcgctattttagatgatttacggggagcacaagctaaaattgcgattactacacactatccggaattaaagctttacggctataatcgtgcaagaactacgaatgcctcaatggaatttgatttaaagaaacttgctccaacgtatcgtttgagaattggtatccctggacaaagtaatgcctttgccattgcacatcaattagggatgaatgaagttgtagtcgacaaggctagaagtttgatgaatgacgaagatagtgatattaataagatgattgaacgattgacggagcagactaaggctgctgagcaacttcatgaaactttaaagcaaaatgttgaccaaagtatcactcttaagcgtcaactccagaatggtcttgactggtataatcaacaagtacaaaagcaacttgaaaaagctcaagaaaaagctgatgaaatgcttgctaaaaagcgtcaaaaagctgataagatcatcaatgatcttgaagaacaaagaagagctgggggtcaagttagaaccaataaagttattgaagctaaaggtgctttaaataaacttgagcgtgaaaatcaaaacttggcccagaacaaggtcttgcaacgtgaaaagcggcgtcatgatgtaagtgttggtgatactgtgaaagttctatcttatggacaacaaggtgtaattacgaaaaaacttgctgatcatgaattcgaagttcaaattggtattttgaaggttaaagtcactgatcgggatgttgaaaagattagtacacaagctgctcctaagaaggcagaaagagcggttcgctcgagtcgtgaccttcgttctacgcgtgcaagtagtgagcttgacttaaggggacaacgctatgaagaagctctaactaacttagatcgctacattgattcttccctcttagccggtttgaataccgtcacaattatccacggaattggaactggggcaattagaaatggtgttcaacaatacttgaagagaaacagacacgtaaagagctatagttatgcgcctgctaaccaaggtggaactggagcgacaatcgtttatttacagtaagcaatatacttgcaaaaagtaagtaattctactaaactatacttataatttaaagaatttatttgtgaggtaataacaatggttgatgaaattacagatgcaacttttgaagaagaaactagcgaaggcgttgttttaattgatttttgggcaacttggtgtggtccatgtaagatgcaatcaccagttattgaccaactttctgaagaaatggatgatgtaaaattcaccaaaatggatgttgatcaaaaccaagaaactgctcgtaacttaggaattatggcaatcccaactttattaattaagaaagatggaaagattgttgaccgtttaactggttatactcctaaggaaaaacttgaacaaattttagatcaatatactgactaatataaataaaaaaaaccgggtaagcctctgtattgagacttacccggtttttattattgctattctcttacttggttaatagttagtcagattgcgcagtgatttgaactacgtgctttttagtaacagtagctgaagcttcagttggagtaccattttggcgctctaaacattccgcaataattccactttcaagtgaaaattcatcactttggctatcaagcctatcagttacgacctggccggataattcaaaaactgcggtatgtttgcgatctttaagtacttttaaagttccaaattgagccatatcaaaaaattcgattaaatcatcgatatctgataaatcatatttacgactaacatgttttccggcccagtaaagaatttctttatcttcgctacctaaaatggtaggtaagataaaatcacgatataatgaatttaaaaaataaagatgttcgtttgtatgttccatgctttcatttccttttgtcttctatatcattttaacttaaaataggtggagtagaaaagagaatttaatcatcatttatttaaaggagtttttttaatggataatcgaccaattggagttttagattcaggattaggcggcttaaccgttttaaaaaaagtaattgaaaaaatgcctaatgagtcaacaatttttattggcgaccaggctaatatgccgtatggggatcgctcaagagaagaaattatttctctaactcgcgatagtgtaaacttcttattaagtaaagatgtaaaaattattatttttggttgtaacacagcaaccgctgtagcaatggcaactattcagaaagaaataccactacagataattggtgttgttcaatctggtgctttagctgcagcaagaactacagaaactaaaaatgtagctgtaattggtactaaggccactgtggctagtcattcttatttaaaagaaattcagtatcgtgatccagaaattaaggtcagtgaatttgctcaaccaaaattagcgccactagctgaagaagatcccgatgaagatactaagaatgcagtggttagcgaaagtttaactccattgaaaaatgctgattatgataccttagttttaggctgcacacattatcctttattgagagacgaaattgtggctgtggtgggtcaagataaaaaaattgtagatccagctgatcaagtggcacaatatacatataatgttttgcgacgtgatgatttatttgctgagagtactgctccggtaaaacatgactactatacaactggagaagcaaagaagtttactgaaattacccgtcaatggatgaatgatgacacgatagttggtcatcatgtagatgctgaggattaaaaatggatactttattatttgcaactaacaataaaaataaggctagagaagttgaagaggccttaaagaaaataaattttcccattcatgtaattactaatcaggacctaactgatcctccccatgttctagaaactgggacaacatttttagctaatgcaaaactaaaagctcataaaatggcggagttcagtaatttaccaactcttgctgatgattcaggtttatcagttgataaattaaacggagctcctggagttcattctgctcgctacggaggcgaagctcataatgatgccttaaataatgcaaaattattggctgaactaggcggtgttccccgagagaaaagacaagctacttttcatacaactatggtagtttcgtggccaggtagatttgatgatgatttagtaacacaaggtgaaattagaggcgaaattttaacttatccgcgaggggatggagattttggctatgatccacttttctttgttcctgataaggggaagacatttgctgaaatgacagtagatgaaaaaaatgctatttctcaccgtggccaagctttaagaaaattacttgctgagctgccaacttggtggaaaaaaatggaaaatgaataattaagagtgacttaaaagacttagttctgatattttattggaattaagtcttttttatataaatacatattttattatatataatgtggtattaggccttttttagcgttaaaatacctttgataaagggaagtttttaaggagattgaggccacatgttattcaataaacgtgacttagatacaaaacaaagatttagtataagaaagttaactattggaacttgttctgttcttttatcaactttatttttaggaataggtactaatgaagtagttcatgcagatactttacctaataatgttcaagaacagaatgcacaaactaataaaaatgatgctcaaaaagatgaagtaattgatgctagtcaagttcaagattctaagatagagggatctaatcaagctcaaaaaggtattacagattcagaaaagactgcagataagaatgcagtccaaaagtctgatgaaattaagaaggatgatgtagagaatactacagttcctactcaaaatagtaatcaacagagtacaactgccaagtctgcagaaactccttctattgttcaaaaaactgaaacttcaaagcctgattcttctattcctcaaactaaaagtgaaacagattctttaaatcaaaaaaataatgctaatgctgcagctcagaatactactacacttaatataagtaacgttgctgctaaggctaatgttaatgctcttaaagaaaataagactgtagcagcaaccgccaccacacctactacaaatggtggctatgattctgctacttggggaacattagatacgtccaagtggaccggacagaatacaacctttgatggaactgattactaccaattaactggttataccggtgatcaaactcatattattgtgccaaatcaagctgactttgagcaagctggaaaatcaactaataatcttcaagtatcgatctctaatgatttaattaaaagctggcaaaatgctgctactattgcctttagtaagactgatgataagaagattaagcttataagtactaatttagacaatactttcaacaagaatactactttgaccaatttagatgccaacagtttagacacaagtagcgttacttcgatgcaaagtacttttgaaggtgcttctaacctatcatctttgactggaatcagtgactgggatgtttccaatgtaactaatatgtcccttttattccaaaatgcgactggcttgactagtttaactggtttgaaaaactgggatgttcaaaaagttacgaatatgactcggattttcaaccaggttaccaaagttacagatctttctcctttgagcaattggaagactgatagtttacaaaaacttaacactgcatttgctaataatagttttacgaacttacaaggtctagaaaattggaatgtaagtcatgtaactgacatgggtgtcatttttatgagtgatgctaatttgactgacattagtgccttagctaattgggatactagcaatgtgactgatcttaatcgggcatttaatgttaaccaatcactaactagcctgcatggtttagaaaactggaataccagtaaggtaaccaatcttaatgcaacttttgccaatgaaggatcattggttgatgcaagtgcgattgctaattggaacacgagcaatgttaccaatatgtcagttttgtttgctgattcaagtgctcagtatgttgatttttctaactgggactttagtaaggtgactagtgcatcgaatgtcataaataatactaagtcagtcgtttatctcggtaataactctacccttactgctgataagttaaacaccttgggtattgccaatggtggcttcactcagccaatcattttagctagtggtaatctctatactcttttatccaataaaaatagtaatacacataatattactattaataatgccagtggtagccaacttactactatttctgcacccgttgtttatgatgcagctagcgcaagtaacatgaccgatgccattaatagttacaaagacatggttgatcaaaagcttgaagattatgttactgaacataactatgtactaaagagagtttcaagtgcccctgttgatgatgtcacgggtcacaataatcatctagttaactatgcgaatgctacataccaagttgttactattccagcagatcaaaagaaaaatcttcagattcaagataagactacctataaagggaagactttaacagctaaagatttagttactaatgttgctgattttccagcaggtactacatttgaatttgctgataatagtgaaccaaattgggatcaagtaggaacctataatgttaaagttattgcaacttatccagtttctgtaaatggtcagcaatacacggccgtaactactccagctactgccaaggttactgttactcaacaaatgcagtttacgattacttactgggatgatacggaaaataaggaaattactcaatttgatatagcaaatgctggtaatggggcatatacttatctttcatttccaaaaggtataaatccaaacaattatcaatccgtcagtgtctctggggtgcctgaaggagcaacaattgctggggatttctggaagccgtttacagatccaagttgtaattggacagtaccaaattataagtgggatgcgacggcagctccttcgttatttgatgctaatgttgttgtccacttaattcataaaacacaagacgtaaccaatacggacccaggtgcacaagaaacacgtacggtgacggctgatttcgttaagattaatgaaaatggtacacccgaagccgcaccttttgattcagctactttagacgtttactacattcgcaaagctactaaagatttggtaactggtaaagttacttatggtaattggaaattaaatacaaataagggtaccaatggtcttcaagtagttagtggagcttggactttaccaacagatagtagttccaagattactgtcactgctcctgatcttgacggctatgaaaaagcggattctctagttaatgggcagttaactacgaactttggtacggttgataatatcaccagtaaattaacgacttactatgtacctacatcattgacacaaaaaactattaaccgtgtaattaacatgattgggatcgataaatctataaacgggtctgcaatggtcaaaccatctaccaccactcaatcagccacgattactagacctgttaaagtaaatgctgatgatagtggagtaacatttgatggctttgatgggagtggctggactacaggtaagtggggacgctacaacaatataccggttcctaataattatacgaaagtcattaaacaaattgttacgcatcctgatggcacaactactgaaacaacgttagatattcctaagtggagacctattccagctcaaactgtcactatcgatacccttccgactgtaattaatataacctatacggcaactgcaacagcatttttggcaggtactagtgagtcaacttatactggcagtccaatcactcttgatgaccttaatgatggaaacggtgataatccaatctatgctgaagttacagggccaacaggaggccgctatactttacaggctggagatgttgaattttcatctgataatggtaaaacttggacgactgaaatgccaactaatgcaggcacctatgaattacgttggtcacaacaaggtaagcaggatgttataaaagaatttggtaataacagtattaaatgggtagatgctcagggtaattcaacctttaccagtactgcaacctatattattaatccggcaccagctactttcactttaagcaaccagacatctggaaattatactaagatctatgaggcccaaccaacgactagtatcgatccttcaaaattaacaattactgttgactttaacaatgccaaagtagttttagatacgactggcctcaccagtgatagttatgagtgggtagatgctcagggtaattcgatcagtaatcctgaaaatgttggaacttactacataaaacttaaggacgctgcactatctactctacagaaggataatcctaactttactttgactaatagtaataaattagctgagtacaccattacgcaagctcaggcaagtggtgtattaagtggctctaactcacggacatacgatggtcaagctactacacctgctgaagtaaatagcaatggtcaaattggcgtaacggtaaccttcccaggtgttactgatgctaacaagacctatattcttaaagatggtgactacaagtggagtagtggctctgcaccaactaatgctgggtcatatacgattactttgacacctgatggtatttccaaccttgaaaaatatattcttggtttagcaggttctggtcaaaataacacaccgaatgtagtattttctgataatgcctttactggaagtgcaagttatacaattaatgttgctgaaaatactgtaagtgtcgatggaacccaaacagaaacttacaccggtcaagaaattagcgttaaatacaacgcgaatggcactaacagcgttcaagtaagtattagctctaaagatggagcaaccgctagcttaagcaatgtacagttagattctggtgatttccaaattgttgatgtcagcggtaagcctatcattgcaacaaatgctggtggtgtttatcatattgtcttaactgatactggtgttgcgaagattcaacaagcggttggtgataattacaagattagccaagggacgagtttcggtactttagttattaataaggtccaagcatctgcagaatttagtggcaatccttcgtacacttatactggtagccctaatagtgattacttaaacggcttctcaattaagctgaatgaaccaaataatccaacttataacttagttgctggtgatattgaatttaatgttgatgggacttggactactgctgttccagttaatgttggaaaatatgaagttcgcttatcacaagacggttggaatcatatcaaagagattaatagtgataatgtaacttggtctgccaccgcatctagtggaactggtacttacaccattactcctgctagcgctaatactgaacttagcggtcacaattcgatggtttacaatggcagctcagtaacgacagctgatttgtatactgatggttcaaccatcgaggtagctattagtggtaataatattgttaacttaccaactagttttactcttgcagatggagactatacttggaatactccagatggtaaagcccctgttaatgcagggtcctatactctgactctttctagcgcaggtcttgataaaattcaagctgcaattgatgaagcagttggtaaaggtaatgttatcttgtctaaggacaatacagggagtgccactttccaaattacacaagccgtgtcaccagacgttcagttagatggtaacgaaaagagtgaatacaatggtcacgcagtcagcttcgatccaaataatgaagaaaccaagaagaactttggcttcaataatgttcaaggtttgactattccagatttaactgctgatgactttgaatgggtcgatcaagatggcaacccaatttctgcaccaactgatgcaggttactactacctccaattgaatgaaaaaggtaagtccgcttttgcgaatgctaaccctaactacacatttgttaaggatggaaatagtacgatttcagggcgcattacttaccacatttatccagcaagcttgattatcggcgtaagtggaactgcatcacaagtttataatggtcaaaatgcagccattacccaaacacagcttgataatggtgatattaaattagtgtggggtaactcaaatgatgagccaattggattgggaagcttcactttaaccccagaagatttagaagtggttgatagtgctggtgatccagtcagccatgctaatgcgcaagaaaacgataaagtaggcaatccaacttattatgttcgtctaactaatgctgcgcttaataaaattaaggccttaacaggtgcaagtaattatgacattagtttaagtgaaactactggtaatttcttaatctatgctcgcaaggctcaagttactttaagcggtaatcaaactaccacttacgggactgatttagctctcgacccaagcgtctaccacattgaactaactaattggaatagcagtgttcctgtgccaactgatgctgaaattattcaagcaattggtgggttgaagtctggggatgtctatattaatggctttactaatggtcaaatgccagtcaatgttggctcttaccaagttaagattactgatcaactactgcaaagactccaagcagcttttccagactatgattgggatgctgttagcgggaataatggcactgctagaagtgggtcgtctgattcagatcctattgatgctagacatgaaccagctacatatgtaattacaccggctgatactacggttacgattaatggcgcagagcacattaaatatggtgaaaattcgacgattcaatatggtagcgataatggttacagtataactattactgcacctgtcaagaatgcaacaactgacaatgaacatgagccaatttatacagatttgaagcttgaaacaggcgatttagagtttgtaactactccaggtaatgttggcacttatgaagttaaattatctgctcaaggattgaagaagctccaagctttaactggttcaactaattataattggactcaagcttctgaagcacgagcaaacttctttgttgaccagatgccagtgacaattaccgttggtggtaatgagcaaaacgtaacttatagctccaatgattggttaaaggctattaaggagaatcctcaaggttataccttaactgtgatgaccgaaaatggtactactttaaactaccaagctaaagatggagatttgatttttagtcaaacaccaggagatgttggtagttatcaagttgttctatcagctcaaggtctggataatatcaagcaggcactgggtactaactatgcttatccacaggccgcaagcgatgtaactacttatggcacctttaatgtgaaccaaggcgaagtcacgatcagcttagatggtagtgatagtaagatctatgatggaaaaactactgtaccagctgatttgaatattggtaaatataatttaacttattcagcccctgtttatgctccagacggtagcccacaaacaattaagttaactagtgatgatttgcagtttgctaatggtgatcctattaatgctggaacttatacagttgaattatcaccagccggtcaagctaagttgaagaatttaactggcaacaatggcgataactacaagtggatatttaacacccaggcaacttacacgattaattcagctactgatgctagtgcaagcttgtcaggttctaaccaaatgatatttaatggctcgccagtaactacggctgaaattaacaatggtggtaacatcgttgttaacttgaatttccctggtagcactgaaaatagcatttaccacttgcaagatggtgattatatttggaatgatggagctgctccaactaatgtaggtacttacactattaagttgacccaagctggtttggctcatttgcaagctgcaattgaccaatatgctggttcaggaaatgcaaaaattagtgcggatagcttaactggttcagctacttttgaaatcgttcctaagtcaattactgatgtcaccatctcgggcaaggatcaagaaaagacttacgatggtcaggctgctagtttagatgtaaatgacttaacgattagcgctactaatcttgttactgatagtccattatcaatgaaagacattactgccagtgattttgattggtatgatgcccaaggtaagaagctagatgcgattccagctgatgctggcacttatgaagctcgtttgaaaccttctgctttgcaagcattacaaaaggataatcctaactacagttttaataccgcaagtggaacgattaagtacacaattaatcaaaaagcagctactgatactttagatggaaatggtaataaggtttacaatggtcaagaaactacggttagtgatgttcttaattcaattacttggacgccaagtgggatagttgatggccaaagcttagatctttctaagctaagcgacgctgattatgcttggtataccaagaatgcagacggtacatacactgaaatggccggtttaccgactaatgctggtacttactacttgaagcttaaggatagttcaattgctaaaattcaggtagctaaccctaactacagttttgccactggtgcaattagcggtgagtatacttatgttattactcaagctaatgctgtgattactttgccaaatactagcgatcaaactgttacttggactggtaatccggcaacaattgatcccgctaactttattccagaaatcactactgataatccgaatgaaaagaccatcgttttgccaagtactttgcaattgactgcaagtgattacgaattctcacaaaatggaaaagtgatttctgcaccaagcgaagttggaacttatcaagttcgtttaaccgaagctggctggcaaaaagttcaaaatgcgattgctgaaaataccaactatacttggaattaccaaggtgaaggtaattatcatattgaaaaggctactgcaaacgttactcttgatggttcagcttcaacaatttacacaggaaattcagtagtaattccagctactgctggagttgttaacggcattaatgtgaagttatcaaatggccaaacttatgtcttaaaacctgaagatcttgaattcgtgaatgatcaaggcaatcaaattcctgcaccaactgatgcaggtacttacaaagtaagattaaccaagatagccttagatcaaattcgaaatattgaaagcaaccattataactatacttataataatgatgcggtagactttacaattgaaaaagctaatgctgatgtaataacttcaggttcatatgatgtagtttacaacggccaaactcctgagattaatgttgatatgattactaacactattgctacgaacaatgatgtaaagcttactgcaccaactttaactgctgacgactatgaatgggttgatgaaactggtaaggtaattactgatcctgtaaatgtaggtacttactacttgaaactcaaagattctagtcaaagtaagattgctaataatagtaattacatttggaacttcaagggtttagctagtgtcacaattagtaaggcgaatgcaactattggttttaatggtaatcaagaaacttcttatacaggaagtgtcatagcagtagatcctgataaatttgaagttaaactttctaacggtcaaacttaccaattgactgacaaagatattcaagttatcggtaatccaataaatgttggtacttacaaagttgagttaagccaagctggaatcgattcaatcaaggcagctgatagtaattacaactacagttatgatgacagtcagggagtgctagtaattgttccagctaaggctagtgcaactataagtggttctcaaactactcaagacttagaacttgatcctcataactactcagttgttttaacgttaaacggacagcaacaaactattactgggttaacagcaagtgattttgtcttcagtaaagatggtcatccggctcaattaactgaagctggaacttatgacgttgagcttagtggggatgcaatcaataagattcgtcaagaaaatccaaattacaatattgacttcagttcaacagcgacatttactttggaaaatagtagccaaactattaactatgtggatgctgataataatgtaattggttcaactaatattagcggtcacattaagggaactaaactaccatttactcctgaaattccagtaggttgggtagcaagtgatccaagtgatgtaccaactgaaattaccattaataatggaactactataattaagattaaacatggaacaactaatgtagatcataataatccggttcctgatggtgcaaagactgtaacaggtgaagtaattgatggtgctcacgcaagtgacttgaaccaaacaattactcgtacaatcaatgtaactaacccagatggaactaagagtacagaagttcagaccgcaaagatttatcgtgatgcaagttacgataatgtgactggtgaagtaacttatggagaatggtcaactggaagctggaaagaatttagtccagcagagatcgaaggttacagtgcaagtgaaaaagtagttccagctgtcgaagttaaagacggtcaaaagaatgtcacagttgatattacttacacagctaatgaacaaagtggaataatttcttaccaagacgaagcaggtaaagaaattagcactactccacttagcggtaagactggtgaaacagtaacagttaacccagaaattccagcaggctgggaattagttccaggtcaagaaattccaaagactgtcactgctacaggagagggaattccaactgtagtaattaagattgaacatggaataaccaatgttgatcataataatccggttcctgatggtgcaaagactgtaacaggtgaagtaattaatggtgctcacgcaagtgacttgaaccaaacaattactcgtacaatcaatgtaactaatccagatggaactaagaatacagaagttcaaaccgcaaagctttaccgtaatgcaagttacgataatgtaactggtgcagtaacatatggagaatggtcaactggaagttggaaagaatttagtccagctgagatcaaaggctacaccgcaagtgagaaagtagttccagctgtcgaagttaaagacggtcaaccagatgagactatcaatattacttacacagctaatgaacaaagtggaataatttcttaccaagacgaagcaggtaaggaaattagcactactccacttagcggtaagactggtgaaacagtaacagttaactcagaaattccagcaggctgggaattagttccaggtcaagaaattccaaagactgttactgctacgggagagggaattccaactgtagtaattaaggttgagaattcaactattattgttactccggaaacacctgaaaaagatattccaaatggaaaagtacctggcaatccaagtaagaactaccctgaaatggaaaaacttgaagtggctccaactcgtgctatcatccttataaaaccagatggtagcagagaaaacattatccaaaaggtaatctttactagatctgctacattcaatgaagtaacaggcgaaataacctatagtgcatggaaattaagtaattctgatgatcatgaagctctctgggaagcttatgaaccaatgagtatttcaggatacacggttatgaatgtaaaccaagaaaaggttacgccggatacacctaatactcagctagaagttacttatattccgattaatcgtcctgcagtaactgcaactcaaacaattcattttgttgatgaaaaaggtaaattagttgagagtaaaatctacactggaaaattcggtgaggttatttctgttagcctatcggttcctaagggttacagtttaaggaatggccaatcattaccaacacaaattaccattgaaaatggtatgataaccattaatctaaaatcagaaagtaagcatcctattcctaactctgagaacaaacagaaaccttctgtaacaccaaatactcctgatgctcatactgataaaaataatttatcttcaaaagataataaagttgttaagtctcatggagaaaaattaataaatactaaccatgttgaccacgttgttattaatcaaaaagccacaagaaagggcacaaaggcttcatcacaaacttatggtgaaaagcactttgaaagcagacatatgcttccacaaactggggcacattctgaaaatccaatttttacagctttaggtatgttagcagtaggcttaggtttattcggtttaagtgatcggagaaagaaaaaggataaatagtaatacttggttactgaaaaattaaaggtaaaagagtaacgaaagaagcaagctaagttagcttgcttcttttttattatttaacatatagataataacttttgtttatgaaagcgctatacttagaatgaaagaatagttatataagtttaagtagatttcgaggttatagcatatgaaaaaagttctggcaattaattctggaagttcgtctttcaaatataagttattttctttccctaatgagaaagtaattgcttcgggaatggccgatagagtaggaaaagaaaatgctgtctttaaaattaagttgagtaatggtcaagaatatataaaaaatctgcctattcataaccaagaagaggcagttaaattattaattgaagatttaaaaaaatttcacgtagttgaagatttgcgagaaattagtggtgttggtcatagagtagtaaatggaggagaaattttcaaagaatcagtccatgttaaagaaaaggaattacaagaaatatttgatcttggagaactggcaccgttgcataatattccagaagcaaatggtattaaggcatttatgagaattatccctaatgtacctcaagtagcagtttttgatacttcatatcatcaaactttagatcagattcactatctttactccattccttatgagtattatcaaaaatacggtattagaaagtatggtgcgcacggaatttcaatttcctatgtggcacaacgtgcggcaaaaatgcttaataagaatcctaacttagttaatttgattgtttgtcatttaggatctggggcttctgttaccgcagtaaaaaatgaaaaatcttatgatacttcaatgggaattagtccacttactggggtaacaatgggaactagaagtggtgactttgacccagctgccttacaacgtttaatgcataaaactggaatgaatatcgatgaagctgttaaagttttgaactataaatcaggattattggggatttcaggtgtatcttcagatatgagagatttaattgagagcaaagataaacgtgcaacgctagctcgaaagatatttattaatcgtgtagttaggtatgttggtgcatatgcagctgaattaaatggtgttgatgcaattatatttactgctggaattggagaacatgatcctggcattagagccggagtgatggcatcattaaaatatttaggactagatcctgattttaaagctaatcggacagatggagaaaagtttatttctaaacctaattcaaaagtaaaagcaatgattgttcctactaacgaagaattaatgattgctcgtgaggtagtgcgagttttgcaataaaaaaagattaagtaggattagacaaaggtctaactacttaatcttttaagaagtagtagtattttcttgttttgtaggtagggaactaaattttatatcttgttgattgaactctttgatataagcgctcagataagcattttttacctggctttgactgttagccactacttgaaaatgaatctggtaagtaatacttgaaccagtttgattgataatgccaataatttgtgggccctttttaatttgatttttaaatttatctttgagtgctgcatttactgtgttaattgcatggttaacggttgtaagatcgttatcaacagataaattcaaattaatgttcatactccatccagaatgtgaaccatgagttaaattttctacaatagtaatattgcgattgggaatatagataactgccccattggtagttttaagacgagtattacgtaaagtaaaagaaagaacagttccagtataggttccaatcttgacagtatcaccaatgttatattcgccctcactgagaatatttattcccgttattacgtcacttactaggccttgtgctcccattctaaagcaagagaaacaagtcccacactagcgataagagtgccaactggaatacctagaagtgttaaaagactgtataaataaaacaaaagaattgtatattgaaaaagagcaacaccaagttgagctaaggttctttttcgaccagtcatgtgttcttgaaactttggatttttcagtaagtagcgagttaataagcgtttacctatacgccaaatcaagaaaaagattccagttgtaattagaatttgagtaccacgacttaagagtgtatgaagtacactattccaatcaattagagaatcaacattactattttttttagttgtagatgttccttttaaaatcgttgaccagttcaaaacatcatctccttagcaatttctttagatagtatatcaaaaagtaaggtactatttcattgcttgaggggaggaataatgctagactttttatgagaggaataattaatggaggatagattatgtcaatttcatatggtgcattagctggcttgattgcagcagtagcctttttaatcttagtcttatttactttgcctttaattgttagagcaactaagacaatgaagaaagttgactcaactatggatagcgttaatatagcagttgatgacttaactaagcaaactgcagtattgatgaaacaaagtgaagatttattagaaaaaagtaatgctcttctagccgatgtaaatggtaaagtaaccgaattagaaccagttgtgaaggcagctgcagatttaggtgaaagcgtgtcagatattaattcttcatcaagaagaatgattgagcgcttctctggtatgggtattagaggagctggaattggcatcttttcatctctagttagtcgaatgttcgcaagacgtaagcgtcgtcgtggggaagactaatatttattaaaggagaacaattatgcgtaaattaggtggatttttattaggtagcgttgtcggtttaggtgttggcttgattgctggctcattattattaccagaagaaacaactgatgatgtaaagaaaaagctagctgaaaacgaaaagttacaagacttaaaagagaaatatgataagggaactgaagcaattaagaaccaattagcatcattccctaaatcagttgaagatgattcagaattgaaagattttgatgatatcgtaattgatgatactaacaaagatcttggtgaagatgaaaaatctgacaaagaagctgttagtgatctaaataacgctgaaaaaaattaattaatattaaagaatcaagttttcacttggttctttttttgtataaaaaaactggtgatagagataaactatcaccagttaatttagtataaattagtctttaacgggaatgtatttcaattctttacttgttttagtaaaagtctcaaaaccattctttgttacaacaccacagtcttcgattctaacaccagctacgttaggaatataaatacctggctcaattgagaaacacatgccttcttcaagaacaacatcatttccttccataatttgtggaaattcatgaacgttcatcccgataccatgaccaagacggtggatgaagtattcaccatagcctgctttagttatgatatctctagcaacagcatcaagttcgctagctgtaataccaggctttgcggcttcaatcgctgcttgttgggcttcacggtcaacttcgtagatttctttttctttagcagttggttctccgtaagcaacagttctacttgagtcagaagcatagccattatgcattgttccaaggtcaaaaagaactaattcatttggttcaattttgttcatggttggaccaagatgagggttagcagcatttttaccagcttgaacgattgtttcaaaactagtgtgcattacacctttttgaagttttaactggtaatcaatttgaccagcaacgtagcgttcagttacaccatttttaagggcattaaagccaatttgaaaagcaaagtctgcttctgcaccagcagcctttaattgttcaacttcctctggtgttttacgtaagcgtgcttcagcaacaaatggggatacattatttgtaaatgaagaatcaggaaaggcgattcttaatgcttctaagcgatcaactgaaagatgggctttttcaatagcaatattatttggagtaccaatacgctgatttaccaagtcagcgatttttgaccatggattttcgtgatctaggtagccataaacatctccatcccaagccgaatttttagcttcttcaacatttaactcaggtgcaaaaataaaggctgacttatctttaaaagcaagtaaagcaaaaattctttcatgaggatccatgctatagcgagtaaagtaattaatactaattggatcagagatgtaggcaacatcattattggttgaaattaaccaattttgtaacttatctaagttcataattttaactccttttttaacatatactgggagtatatcatataatatggtaaaataattagtttttagtcgtaaacggttgcaatgtcttgatattcttgataagttataaaagagtgtttttacaggagtgtgagaaatttatgcaaaaacaagaagtaactatttatgatgttgctcgtgaagcaaaagtttctatggctactgtttcaagagtagtaaatggaaataataatgtacgtaaagaaacacgtgaaaaggtattagctgtcattgaccgtttgcattaccaacctaatgccgtagctcaaggattagcttcaaagagaaccacaacagttggtttgattgttcccgatttaacgaatatgcactttgcagaattatctaaaggaattgacgatattgctacgatgtataagtacaatatcttactttctagcgtcggtaatacgttgttaaatgaagatcaagtgatccaaaacttacttaataagcaagttgatggtgtaatttatatgtcaaacttaatgagtgaaagtgcacaagagatttttaaacgcactaatacaccagttgttttggcagggactgctgatgcaaatcacgattttcctagtgtaacaattgattataaggcagctgaaaaagaagctttaggcttattattaaagaatggtaagaaaaatcttgctttagttgttggtgatggaaaagcttatgttaataaggacaatcgctttgtagcttataaagattttatggaagaacataatttagataatgttcatatctatgaagatgctagaacttacgaagatggctatgaattatttgaacaaattaaagcagataaagtagatggaattattgctactcgtgctgtaactgcagcaggtattactaatgcagcagttgatgcgggcgtatccattccagatgacttagaaattatctccgcggcttcaactaatgtggctaaaattgttcgtccgcaattaaccactgttcaacaaccactttatgatatcggtgctgttgcaatgagaatgttaactaaattaatgagtgacgaagaactagatgaagctcatgttatcttgccatatactttaaagcaatctcgttctactaaataaagtatagttataccaaaaatcctcttaggttaaactcaacctaagaggattttttaatatataaatttctaattatggagcagtaggagcattatctgctgccgcatcacctgcagtagcttctgtgctagcagatccgctaataggagcactttcacttggactaatatttgaatttacttcattagcttcattagcgttactactttctgatctgttattttgagatgaagaagcctcacgagtagaagtggtacttctcgtagttgaggaagaattattgtttcctccttgtcctgtactcctagcttgttcatcattagctcctacattccgattagttgaggaagaagaattattattagattcacgataaacttcatggtttttaccataataattttttgcattttctgaagttgatccatcagctacagagaagagaccattaatattcttcttcttagaaatcgtcttaccagtgtagattaagactttaccatagtcattatttttaccttctaagtaatcatagaagaggttgtagtctttagttgagccaccaataccaaatctagcagttgcatttggtgctggtgaaagacttaatgcggtagtctttttgccactgagatcaatattatcgccatcatagcttaccgttccaggtaatgttcctgttcttgctaagactctatttttataaacggagcgtggacgcgtaggagcatcatttaatttaaagatcgatggatcttccttatataatgcattagcaatattgacccataaatttaaattagtctcactagaattagaatctaagttgtatgaatgaccatagaagttatcatagcccatccaactagaaattgtaattccaggagtagatccattaaaccaaatatcacgataatcattactggttccagttttaccaattagattcttgtagtcgaacttcaaggtaccggttaagctcgaagctgtccctttagttactacttggtgtagcatcttctgcataatgtaggaagtgcctgtagagaagactttctgtgaatcttgtttgtgtttatagattactcgaccggatggatcttgaatttcttcaatataatatggatccgcacgtttaccattgttatagaagttagaaaaagcactagcattatcggctactgaaaaaccgtaatcagtaccaccaagagctaatcctaagttttcaaattcgctcttacttaaatttaagcctaatttcttcatatcttgacgcagattgatatttttatcgttaactaacttactgtataaatttacagcaggaaggttataagacttacttaaagcttcctgagctgaaataaatctgttttcaacagttgagttatagtcagttggaatatagttaccaaatctggtagggaagtcagcaattgcagtttggcttgaaataagcttatgctctatagctgggccataaactaaatatggcttaattgaagaaccaggagagcggtaagtatcaaaggcatggttaatttgagaatttttaaagtcaaccccaccgctaaatgctaagaccttaccggtagcattatcaattacgacactaccgttttccacgtgttcggtggtattaacccacttgttagtagaagaatcaaaatcgcgagaagttcggtcttgaccatacttgttttgcttaacaacttgttgcatggtctggtatagtggctttctaattgtagttttgatgtgatagcctttttgatgaagaagctcagttgcgctagttaggtactgattatagcggtttatatcttgtttaacgtcagatacttttaaaccatcttgttcaatcaagttttcggctaaaagactggcactcttattcattactagattgtataaataaccgctttgtttcttttgcttcggtgctttttcaggagcaaggaagtcagcgcgcaaatcatattttttagctgcaagataagcttttttactaatgtcgccatttctgtacatacggaataaaacaatgtcttttctccgcattgctaagtcaagatcacttttaacttttccatttaagcgatatggagtatatacagacggactttgaggcagaccagcaataaaagcagcttgcggtaaattaagttcagaaattgatttaccaaatataccttcagcagcagttttaatgccgacaatattttctccgcgattatttttaccataaggggcagcatttaaatatgcacggagaatgtcttctttagaaaaatgtttttcgatcttatgagcataaaacatttcagtaacttttcttctccaggttgtttggctagttaagaattgcatcttaaccaactgctgagttaaagttgacccaccggtctgcacaccaacacctgttaattcagaaaggacagctctaactaaggacttaggtaaaacacccttatgaatataaaagttttcatcctcagtggctgttacagcattcttaacgaggggagttaattcactttcactcgcctttttagtaactgtatctggtcgaacagtagcaatttttttattaccagcatagtagagtgtagctgaattttgagcatgatttatttgatgatttaattcgctaatagttggaataggttgattacgaacaataccaagtgcataaccgccgccaaaaccaattagtaaaaataaaccgaaaaatgcaattaagataaaataatgaaaaacacggcgcaaagttaaatagacgataccactgtaaaatttccactggctttcatctgattcgctttgcagtgttttaacttctggccccgcagttaggaactttctgattttctcttttaaatttttcacagatcaggatcctttgttaattacttttcacctattatagcaaaaaaaggactagcattgatgcagtccttctttacgaatttattaatatttttggtttacttagttaattcataaattgcttcggcgtaaatagcaattgaattgattaaatcatcaaccttcatgtattcatttggttggtgcataacaagtggggcaccttctggttgagcaccaaaagctacaccatgtttgaatagccggccgtatgtaccaccaccaatgataacctcatgtcccttcttaccagtttgtttttcataaacagaaagaagtgtcttaacaattggatcatcgccaggaacatagtgtggagcttcagcagagccttcaactctagcatctaaaatatcaccaaacttttcgttgatatttttcaccatttcttctggttcaataccttgagggtagcgaacattgtttaagaggtatgcattttgaccttcaaagttaaacatacttggtgaactggttaaatcacccattaaatcgtcatggtggaaaatgcctaatttcttaccattgaagtctttatgttcaacagttgctaggaagtgtaagaagttctttgcttggccatcaaagttaagactatcaaggaagagggcaaggtaagtagcagcatttctaccagtttcaggagctgatgcatgagcgccatgaccagttaatgttaaggcaaggcgaccgctaagcatttcagccttaccttcaagtttgtgttctttaaggaaaagatcaaatttttctttaataccgtcaatatcgccttcaagttgggcatgagcagtttgagggatgacgttagtagcaataccggattggaatgtccaaagcttaacgtcaccttggcttgggtcaaatttgaagtcaagctttagagtaacaattccttgttcaccgttgataattggaaattcagcatcaggtgagaaggcaacatcaggagctggttgatgcttgaggtagtaatcaattcctacccaattagtttcttcattagttccaaggacaaaatcaatcttctttttaggcttaaatccatgttcctttaagataagcattccataataagcagctaaagaaggtcctttatcatcagcactaccacgaccatagatttttccatctttaatagtcatcttaaatggatcagtcttccagccttcgccagcaggaacaacatccatatgtccaataatacctacacgtttgtcaccagaacccatattgattcgacctgcatagttatcaaaattttcagtgtcgaaaccatcgcgtttagcaaaagataaaaacttcttcattgctttaactgggccaggaccaactgggtattctttactggtgttgtttaaatcttcagaagaatcaattgcgattaattcttttaaatcatttaaaatagcatcctttttttcctgagctaattttttataatctagttcttccataaatgtactcctttaatttttatctctgattaaatattacagcatttacatcagaataagtcgaccaaaagtttttaattgggactttttctactggtaaataaggaaatagtgcaacgttggtttgacgataagctggatcaagttttcgataattcttataggcaaaagtgttcttattgaatagaccataatataagatcttagaagactttacccagccatagtcagtaagaagccataaatcattgactccgccacttacgcctaatattttatagcgtttattaggcatgagttgggctcttttaccagactgcctatcaggtttattataagtgaaaattggattttgggtaggattaataatacttaaattccaatatggcaaaatccattcaggctgcaaatctaagctaactagatctgcaggaacaaattccttatcaccaatttgataaaaagtttgtcccgatgcaataacagctgaagaaacatggacaggttgtaagaaactaatttgctttgaagttttcacatttagatatgggtttacgctaactccagtcggagtacgaccaaagtaaataccatctttattaacagtatattttttagtaccactcttggccaatttgtatttatagcctcttgcaggaaagttcgttacaactccatctacatcattgttaattaaccagttccataatttaggtgattcattcatttcggcccaaacaaatactttttgatgtagagcatgaagctgactgataagtttaggattttgagtgactaaatcagatgaaatgttaattccatttacatagcttaatacatcaaaattaattctttgcagagagccaacaataaaaattctaggtacatcaggtaataattgactcatagtctttagactaggggcagaaaagctatggatcatgacccgatcttgcatatgatattttttgatactgctagcaagaagctcctccatatttttagggctattatgtttagtctttttcgtttcaagaaggaacttagtattaggtttatctttataataatcaaataattgatctagcgaaatgattgactcaccgttagcttgttttaaggtatttaaataggaaaaattattttgtgatacaataaccggtgatccaacaactcggcttaagtcacggtcatgagaaacgactaagacgttatcttttgaaacatggagatcaagttcaacataatctgcaccatctgcgaaagctgagttgtcactttgaattgtttcttctggatatttgctggggttgcctcggtgtccgataaccagaaatccagattcaaaaataaaaattaaactaaaaaaaagggctaaaaagtaaagccggcttgttttcatgtgtacacctctattctttttaacaatagcatggatgtatacttttttctataattaatatagtagttaaaatcattttaagaaagtagatgctgaaatatggcttatgagcaactagacttgattgaagaagttactcgcaatgacggatcgaaatattatgaaatttcaaatatcgatcaaaacggaattgctgaactagctgtagaccgtggattaattaaaaaagttcgaatcttgcagttgaatttagctcgaactaaatcactacaactatatgaagaatatattaataaaacctaccaattagagaccttaactaatgagaaggattggaaagacccacaatgggtagagtgggaaaaacctaaaggaaaagtattagatgcctataacacagtattaaaagccaatcatattggttagaagaggaaaagtatggaaaaattacgtattattcatactaatgacctacattcacattttgaacaatttcctaaaataaaaagatacttgcatcaagctcaaaatgataagagcgttgatcaaacatttacttttgatgctggtgattttatggatcgatcacattctttgtctgacgcaacagaaggacaggctaacattaaattaatgaatgaatttaattatgatgcaattaccattggaaataatgaaggtatttcaaattctcatgcagttttagaaaaattatttgatcacgctaattttcccgttgtattagctaacctacgtgaggaagatgagagtatgccaaagtggtgtactccctataaaatatttgaaaccaaaaagaagactagaattgcagttgttggtttaacagctgcatatccaatgacatatggtcccaatcattggcatgtgaagttgatttctgatactttagataaattactgccgaagataaagggtcaatatgatatgttaattattgttagtcatattggtttaagggtggatcgatatatagcccatcattatcctgaagtagacttgattgttggcggacatagtcatgactatttagcaaaaggtgaaaaagtaaacaatacttggattactcagacaggaaaatggggtcaacatattggtgacattagtgttgaattaaatgatgagcatcaagtattatcaattaaaccaaacactgtcactactgatgacttaccaagtttagattccgatcaaaagcaaattgtagattggcatcaaaaaggtgagcagatgcttaaagcacgaaaaattgcttatttaccaggtaaatttgatcatgataagatggcagcaattcaagtttcacttgatgcaattagtgaatttgctggaactgatgttgctgtcttgaatagtggtttatttttaaaaccatttcatcagggagttttaacggaagccgacttacaagctgctttgcctcatccaatgcatgtggtacaaactaagctgcttggaagtgatgtttggcgcatggtaatggagatggaaaaaaatcgtcattttctaagtaaatttgcacttaagggaatgagttttagaggtaagatttttggagatcttgtatataagggaatacaagttgatcatgcaagtagaacggtttacattaatggaaaagaaattgatcctgaaaaagaatatacacttgcattgcttgatcactatgttttgattccatttttccctacaatttcaattatgggtaaaaataaatttttattccccgattatctaagaaccgtaataggaaactatttaaaaaagaaatacccaataaataaagagaaagaaaaataatggagtataaagaagcagataaagaccagccgctataccatcctttagctcatgtcattattaatgaagatattgtaatgattaacgggcgagagtatgaaattatagctaacgtaaaagatgctctagacattgaaatgcttaaggagaagtatgacccttatttagatcaatatgattatttagtaggggatgtctcaagtgagcatttgagattaaagggcttttatgatgagaatgatcgcgttgcaattgataaaaaagctaatgcaattgtggattatttagaagaatactgtaatcctggtagtgcatattttattttgcgtttagctcaagaaaatcaaattaaaaaaattgcttttggtaggcaaaataagagaaagagcacaaacaataactgctaccgtgcaaagcgtccttactttaaagaaagacgcgttcataaaacaaagattggcagtcataagacagccgtaaaatttcaacgtggaaatcataaaaataaaagctttgtaattaagaagagaaagggataattgtggaacataaagactataaatgttacttaattgatttagatggaactatttaccgtggcagcgatacgattgaaagtggtgtgagatttatacatcgtctccaagaaaaaaatattccccacttatttttaactaataattcaactcgtacaccacaaatggtagttgataagcttagaggacatggcgttaatactgatatttaccatgtttatacgccagttttagctacagagtcttatttactttctcaaaatccagatgcaactaaaataccaatttatattattggtcaaattggcttagtacaaggcttattaaaaaatgaacgtttttactatgatgatcgaaatccaaaatatgtggttgtagggatggatacagatttaacctaccacaaaattcgtgtagcaactcgagcaattagaaatggtgcaacgtttattggaacaaatgcagataaaaatttaccttctggagatgagctactacctggaaatggcgccctttgcacgatgattgaagtagcaacgggggttaagccaacttacatcggaaagccttcaccgattattgtagcgagtgcattgaaaatgttgaatgcacaaggacaagatgcaattttagttggagataactacgataccgatattatggcggggattaactgcaatattgattcactcttaacgttgacaggcgtaacaaataaggagcagttaaaagaaaaagataagaagccgacatatattgtagagaatctagatgaatggaaactatgaaaagaaaaccgataattgcagttgtttacaatttaatgatggcccttgctaccgcgactttaggagcagttgttttgagctggcccttactagcaatttttgtaaaggctcaaaagactgatttaatagtaagaaagtcactgggaacaataatgaaaaactatactcaacttttggattatttgttgctcccctttaaaaataaattgcaaatgtctgatttccctacttctccgagtgcagcacgccatttttatgagtgtaaattattgtttgaattagcaataattgtctttattgttggattaattattcttatctttttaaaaatgagaaagagaatgaattatatctacatttcgaaaactacagccttaatctttatgattttacctgtaattattttgccttttgctttaatgaattttgatgaatttttcatttcttttcatcacttattatttaacaatagtgactggctttttgatcctactaccgatcctattattaatgtactaacagaggaattctttgcaggatgctttgcaactggtgggataatttatgaattatatttttcatgttttattttgacaaaaaaataaaggagctttaaccaagctccttttttaatactaattttttctttatccaaatgatcaatactggtaccactgagattaagatgattgccaggacaattaatgagaagtgctcttgaacaactggaatatttccaaagaagaatcctagagcagcaaataaagttacccagagaaaaccaccgagaaagttataacggatgaaagtaccataatgcatcttacttgcgccagatacaaatggaacaaaagtacgaataaacggaatgaatcgtccgattacaatagtaattccgccatgcctgtcgaagaaattttcggcagcttttcgtttatcttgattaatcaacttattaaaccaactgtgcttagcaccttcagcttgtgaccaacgaccgatttcataattaattgtatcgcctaaaacagcagctgcaagaaagactaaatagcaaatccaaaagtgaagattgtattttggtgttgctgccattgcacaggcagcaaatataagtgagtctcctggtaaaaatggaaagataactaaacctgtttcaataaaaacaattgcaaacagaattaagtatgtccagtttccaaacatattcacaattgtgactaggtggtcatcaatatgaagaataaaatcaataagtcccataaataactatatattcctttcaaaaattagatactcgtagaatgaaaagtcattgttttttctggaaataggtcttgcataatgctgctaattgcaatttgagcctcgccaaaacctagggcaatcattggtacccggcctgggtaagtaatagcatcaccaattgcgtaaacatgaggcaaatttgtttgcattgtttgagaaacagaaattaaattattttctaattcaatgccccacttacgtaattgacgattatcacttttgaaaccatatgcaactagaatttcatcaacgtctttagtaataaaatcgtgacttgcaccaactctgtgcaaaactaattctattctattattgtttaagtgaagttcttttggaaggtaaggagttaaaagttcaacattttttaaacttttaagttgactaacagaactttcaagtccgcgaaattcatttctccggtgtactacatatacatcagatgttttacttaattccagtgcccaatcgagcgcagagtcgccaccaccaagaatggcgacttttttattagaaaagatttcgggatgttgcatggaatagtgaatatgggcttggagctctggagtagtagataaaggtagagtttttggcttaaatgctcctaaacctgtagcaataagaagacttttcacttgataatcatcatcaatgataatatcttctcctgttgagaaagagattttttttactttatgtgagagggttaatttagtattctcggtttgttcaaataatcgagaaactaattctttccctttaatagaagaaaaagctggtatatctttaatatctttttgtggataaagcatattgatttggccaccaacttcatctaacgcgtcgaaggtaatagtttttaatccatgtaaattagcaaaagaagcagcaaatagaccaaccggcccagcgccgataatagctaaatcatatttttccattgtaataagcaatcctccataagaattaatctagaagtcatgtctttagcgttaattaaaaagacagttataattaatattagtaagggatgagatagtatgcaagttaaaattggtgatatagttcatggaaaaattagcggtatacaacaatacggaatttttgtaagattggacagtcagatagaaggattaattcatatttctgagattcatggtggctacgtaaaagatataggaagagaataccaagttggagaaactataaaggtacaagtcattgatatagatccatattctaatcaaattagcttatctcgacgagcggtacttccagaagtcgaagaagcgagaaaaaagagagttcatttttggacctcaaaaagagctaaaaaggggtttatgccattaaaagaagttttgaataagcaaattcaagaagctaaaattagatattcaaaaaaagattaaaataaagtgttaagcagtagtacttaacactttattttttatatccgaattttaagacttaaatctcaattaaaataagaatgaaaaatgataaatctgaacaattaaattattaattaaatgaatattcgcaatatatatttttattcaaaaccatgttgacgaaaagtaaaaaagtctgtaaagtaatacatgctgtttgaggcaagcgaaaagagcaaataaaaaagttcaaaaaaagcttgtcaaagcgagcaaaagatgataatattataaagctgtcatttgagagagatgagaaaattaaaaaagttcttgtcaaagcttaaaagacatgatataatataaaagttgtcacatgacaacggtagtaccttgaaaactgaacaaagtttcgctgaaagtgtgcgggatataaaaatcccaaacaaaagcgaagtcaattcgcaagcaataaatttgagataactcaaagaaagttttagagctaaacgataaaaagctcattttcaaaaggaaaatgagagtttgatcctggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctcttaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttctaaggaaggcgaaagatgatggagagtgcgagagcactaagagaagtcatcgagaaagccaagcggaagcacactgagaaactttgtttagttttgagggtattacctcaaacaacttgaataacaagccaagcataatcgggcctatagctcagctggttagagcgcacgcctgataagcgtgaggtcgatggttcaagtccatttaggcccattcaaagcaaaaaagctttgataaaaggcaatgatgggggcttagctcagatgggagagcgcctgctttgcacgcaggaggtcatcggttcgatcccgttagcctccattgagacataaagtctcaagggttagtacattgaaaactgaatataatcaaaagcaaaaaaaccgagacaatcgaaaaaacagattgaagagcgaccgagaagagagagaaactcaacttgaaataggtcaagtagaaaagggcgcatggtgaatgccttggcactagaagccgatgaaggacgtgacgaaccacgaaaggcttcggggagcagtaagtaagcaatgatccggagatatccgaatgggggaacccaataccgcgaggtattatcattaactgttaaggttaatgaaggaagacgcagtgaactgaaacatctaagtagctgcaggaagagaaagaaaaatcgatttcccaagtagcggcgagcgaacaggaaagagcccaaaccaactggcttgccagttggggttgtaggactgcgatatagtacttgaagtgatagcagaattatctggaaagataagccagagagggtgagagccccgtacgcgaaattgcggagagacttagcaggatcctgagtaggtcgggacacgaggaatcccgattgaaaccgcgaggaccatctcgcaaggctaaatactaactagtgaccgatagtgaaccagtaccgtgagggaaaggtgaaaagaaccccggaaggggagtgaaagagaacctgaaaccgtgtgcctacaagtagtcagagcacattaaagtgtaatggcgtgccttttgtagaatgaaccggcgagttacgttatggtgcaaggttaagtcagaaaagacggagccggagcgaaagcgagtctgaatagggcgaaagagtatcatgatgtagacccgaaaccaagtgacctacccatgaccaggttgaaggcgtggtaaaacacgctggaggaccgaacccacgtgagttaaaaatcgcggggatgagttgtgggtagcggtgaaattccaaacgaacttggagatagctggttctctccgaaatagctttagggctagcctcgtgtgaatgataatggaggtagagcgctgtttggactaggggcccgtcaggggttactgaatccagataaactccgaatgccagatatcaatgcacgggagtcagactgcgagtgataagatccgtagtcgaaagggaaacagcccagatcaccagttaaggtccccaaatctatgctaagtggaaaaggatgtggagttgcgtagacaactaggatgttggcttagaagcagccaccatttaaagagtgcgtaatagctcactagtcgagtgacgctgcgccgaaaatgtaccggggctaagcatagtaccgaaactgtggatgcatatattatatgcgtggtaggagagcgttctaagtgcggcgaagttagatcgagaggactaatggagcgcttagaagtgagaatgccggtatgagtagcgaaagataggtgagaatcctatccgccgaaagactaaggtttcctggggcaggctcgtccgcccagggtaagtcgggacctaaggtaaggccgagaggcgtagccgatggacaacaggtagaaattcctgtactgaaattgttcgatatgagcaaaggagggacgcaggaggctaatgacgcatgttgctggaaatacatgtgcaagcagtaagaaaaaagatgagtcaaatgcttgtctttagatttcaagctgtgatgcggagcgaaataaaagtagcgaaggtcatgatgtcacactgccaagaaaagcttctagccagaacaattttacccgtaccgcaaaccgacacaggtagtcgagtggagaacactcaggtgagcgagagaactctcgttaaggaactcggcaaaatgaccccgtaacttcgggagaaggggtgctgatagtaaaatatcagccgcagtgaataggcccaaacaactgtttatcaaaaacacaggtatctgcaaaatcgtaagatgacgtataggtgctgacacctgcccggtgctggaaggttaagaggagagcttagcgtaagcgaaggtttgaattgaagccccagtaaacggcggccgtaactataacggtcctaaggtagcgaaattccttgtcgggtaagttccgacctgcacgaaaggtgtaatgatttgggcactgtctcaacgagagactcggtgaaattataatacccgtgaagatgcgggttacccgcgacaggacggaaagaccccatggagctttactgtagcttgatattgagtatttgttaaacatgtacaggataggtaggagccagagaaagtaggacgctagtcttaccggaggcaatgttgggatactacccttgtttgatggatcctctaactcacagagctgagcgttctggaggacagtgtcaggtgggcagtttgactggggcggtcgcctcctaaagtgtaacggaggcgcccaaaggttccctcagaatggttggaaatcattcgcagagtgtaaaggtataagggagcttgactgcgagagctacaactcgagcagggacgaaagtcgggcttagtgatctggtggtactgcatggaaaggccatcactcaacggataaaagctaccctggggataacaggcttatctcccccaagagttcacatcgacggggaggtttggcacctcgatgtcggctcgtcgcatcctggggctgaagtcggtcccaagggttgggctgttcgcccattaaagcggcacgcgagctgggttcagaacgtcgtgagacagttcggtccctatccgtcgtgggcgtaggaaatttgagaggagctgtccttagtacgagaggaccgggatggacataccgctggtgtaccagttgtcttgccaaaggcatcgctgggtagctatgtatggaagggataagcgctgaaagcatctaagtgcgaagcccccctcaagatgagatttccgatgcgaaagcagtaagacaccttaaagacgatgaggtagataggctaggagtggaagcatagcgatatgtggagcggactagtactaatcagtcgagcacttgaccaaagctcaaaggtttaaaggctagagattatattcagttttgagtgtaaaagctcagaaagagtacggtggcgatggcaagaaggatacacctgttcccatgccgaacacagaagttaagcttcttaacgccgagagtagttggtgggaaactgcctgcgagggtaggcagtcgccgtgctcttttttaatattccggcttagctcagttggtagagcacctgactgttaatcaggttgtcgtcagttcgagtctgacagccggagtaaagtgatgagttaaaggaagaatgaagaattatctttgttcttcttttttttgtatagttattatttttttctacttttttaactttatgcaagcattttcaataaaaaaatggtatgatattaaaagcaaacgtatacatttattctgctataaagtattcgtggagatattttgatcaagggggaaatcaaatggtaggaattgtcctagctagtcatggtggctttgctgatggaatctttcaatctgctgaaatgatttttggtaagcaagagaatctggctcatgtgattttaaagcctgatgaaggtccagatgatattagagctaagatggaaaaagctgttgcttcttttgatgatcaagatcaagtattgtttttgattgatctatggggaggtacaccatttaaccaagcaaataatcttgttaaagaacatgaagatacttgggctattgtatcaggtatgaatttacctatggttatcgaagctttgggtcaaagaatggcaagcgataatgctcatgatattgccaaagctattgttaaaccgggtcgtgatggaattaaaacacaacctgaatctcttatgcctaaagaggagacaaaggctgctccagctgctgaggcacaaccacaaggtgctattcctgaaggtactgtcattggtgatggtcacattaagtatgttttagctagaattgattcacgtcttcttcatggacaagttgcaactggttggactaaggctatgaatccaaatcgaatcattgttgtttcagataatgttgcgaaagataaaattcgtaaaacaatgattaaggaagcagcaccagctggtgtaccagcaaatgttgttccaatcaataagatgcttgaagtagtgaaagatccacgttttggaaatactaaggcattgatcttatttgaaaatccagaagatgcacttaaagctattgaaggtggaatggacatcaaagaattgaatgttggatccatggcatatagcgatggtaaagtgaatgtcaatactgttttggcaatggatcaaaaagatattgatacatataagaaattaagagatttgggcgttaaatttgatgtccgtaaagttccttctgatggtaaacaaaacatggatgaacttttggataaagctcaaaaattagttgatgaaaagaaataaattacagggggatttacataaatgaatgctattcagatgattctggtagtgatcgttgccttctttgcaggtatgggaggaattcttgatgaatttcaattccatcaacctctagtggcatgtactttaattggtttggttactggtaacttaactattggtattattcttggcggttcactacaaatgattgctttaggttgggctaatattggtgctgccgttgctccagatgcagctttagcatctgttgcttcaactattattttggttcaaggtggacaaggtcaaaagggtattggtactgctattggtattgctattcctttagccgttgctggtttattcttaactatgttagttcgtactatttctgttgccattgttcatattatggatagaaaagcagaagaagctaactggagagccattgaccgttggcaaatgattgctgttgctttacaaggtttacgaattgctattccagctgcattattacttgctattccagcttctgttgttcgtgcgggcttaaatgcaatgccagcatggttaaacgaaggtatgactatcggtggtggtatggttgttgccgttggttacgctatggttattaatatgatggctagccgtgaagtatggccattcttcatcattggtttctgtttggcagccgttaaagaattaactttaatcgctcttggtggtattggtatttcccttgctattatgtaccttgctcttgaaggttctaagggtggaaacaacaataactctaattctggttcaggcgacccattgggcgatatcctggatgattattaaaatttgagcgagaggaggctaattatataatgactgaaactgcacaaaagaaattaactttaagtaaatcagatcgtattaaggtttggtggcgttctactttccttcaaggttcatggaactatgaaagaatgcaaaacggtggttgggcttacagtttaatcccagcattaagaaaattatatcctgaaaagaaagatctatcccttgcattaaagagacacttggaattctttaatacacacccatacttagcatcacctattatcggtgttactcttgctttggaagaagacaaggctaatggtgcggatgttgataacactgctattcaaggtgttaaagttggtatgatgggacctttagccggtgttggtgacccggtcttttggtacactgttcgtcctattattggttcattaggtgcttcacttgctttgagtggtaacatcttaggacctatcttgttctttgtattatggaatgtaattcgtatggcattcttatggtacactcaagaaatgggttacaaagctggtactaaaattacagaagatgcctcaggtggtttattacaaaagattacccgtggagcttctatgatgggtatgtttgttatcggtgctttaattgagcgttgggtaacaattaacttcaaaccagttgtttcaagcgctccgcttcaaaagggtgcttatattgattggaacacccttccaaaaggagcagaaggtattcacaaagctttgagtgaatacaacctaggtaatggtatggccttagatagaattaagcaaacaaccttacaacaaaacttggatagtttaattcctggtcttgctgcagttctattaactttcttatgtatgtggttattgaagaagaaagtttcgccaattgttatcattattggtatctttgttgttggtattgtaggtcacgtaattggcttactataacaattaatcagataagaaacggtcttgtttagaccgtttttcttatatatgaaaaggtttttatatggttcaatcattaaatacaaaatcagagtatgtagatgctgcgacttggtttagaggaattcctacatatggaaaagttttagtcggagataaagggtttgagttttatagtgataataatccaaatgactatgtacagattccgtgggatgaagtaaccgttgtagttgcggatgtatattttggtggaaaatatattcctcgttttaagatttgtactaaaaaaaatggtagttttatttttgctgcgagacatgtaaagccaactttgcgtgctattagaaagcatgtaccagcagataacatgagaaaagctcttaccatttggcaaaaaatcaaacggaattttaagcaaaagtaataaggagatttagctctgagtctaagctccttattttttgttaaaaaggccttggcattaacgcgtacctgtattaaaatatcattaatcaatttttgatatctaaaactagctctcaagtgactgctagttttttttataggagtggcactaagtaatggaaaataaaaagtcaatgcccaaattgaaacgttccatgacagctggtcaaatggaaatgatatctttaggtggggcaattggtgttggattattcatgggatctacatccactattaaatggaccgggccttcggttttactcgcttatatgtttgttggattaattttgtacattgtaatgcgagccttgggagaaatgttatatgttaatccaggaacaggatcatttgcagattatgcaactgaatatgtccatccattagcgggatatttagctgagtgggctaatgtatttgagtatatagttgttggaatgtctgaagtagttgcagcaactgaatatttaaagttttggtggccaaaagtgaatgtgttttggtcaggaattattattattttgtttttagtgttagcaaatttagctagtgccaaagcatatgcttccctagagttttggtttgcaatgattaaagttgtaactattatcttaatgattattttaggattcattgtaattttctttggagtagggaacggcggaaagccaactgggtttagcaatctatggtcacatggtggctttttcactggtggagtaaaaggcttcttcttctcaatgtcaattattgttggttcatatgagggaatcgagttactaggcatatctgctggtgaggtagcaaatcctaaaaaagccattgttaaaagtgttaaatcggttttgtggcgtatcttaattttctatgttggagcaatttttgttattgttacgatctatccatggaatgaattaagtaatattggctctccatttgtaactacatttgcaaaggtaggaattacagcagcggcaagtattatcaactttgtggttttaacggcagccttgtcaggagcaaactctggaatttattcatctagtagaatgctttttaaattagctcatgatggggatgctcctaaaacctttggacatatttctaaacgaattgttcctaatcatgcaattttagggatttccgggggaatattaattggatttattattaatatgattgcagctacaattaataaatctactcaagatttattcgttgtcgttttctcgtcttcagtcttaccaggtatgattccatggtttgtaatcttacttgctgaactaaaatttagacgcaataatcaagatttactagtagaccatcctttcaagttaccgttataccctatttccaattactttgcatttttgatgctgattgttatagttatctttatgcttattaaccctgaaactagagtttctgtattagtgggagctgctgttttacttatagctacaattgtttatctatttcgacataaaaaggatggtgtaaataatggagaataaacagaatcatcctcctaaattaaagcgatcgatgactgctggacaaatggagatgatctctctaggtggagccattggtgttggattattcatgggatctacatcaactattaaatggacggggccatcagttttattagcctatatgtttgtaggactaattttatacatcgtaatgcgagcattgggagagatgctctatgttagtcctggaacaggatcatttgcagattatgcaacagagtatatttcaccattagcgggatatttagctgagtgggctaatgtctttcaatatattgttgttggtatttcagaagttgtggccgcaacagagtatttaaagttttggtggcctgaagttagtgttttttggtctggaataataattattgctttcttattactggcaaacttggctagtgctaaagcttatggaacactagagttttggtttgcgatgattaaggtagtaacaattgtaataatgattattttaggtttgctggtgattttactcggcgtaggaaatcacggaaaaccaatcggctttagtaatctatggtcacatggtggctttttcactggtggagtaaaaggattctttttctcaatggcaattattgccggttcatatgagggcatagaattaattggtatttctgctggagaagtagccaacccacaagaggcaattgtaaaaagcgtaaaatcagttttatggcgtatcttgattttctacgttggggcaatctttgtgatcgttacaatttatccttggaatcaattaagtaatattggctctccatttgtagagacctttactaaggtagggatcacagcagctgctgggattattaacttcgtagttttaaccgcagccttgtcaggtgcgaattccggtatttattcatctagtagaatgctatttaaattggcacatgagggagaagcgccaaaggcctttggaaaactatcgaagcgtattgttcctgacagagctatcgttggaattacctcaggtattttaatcggctttattttgaatttgataatgtcaaccatgaataagtcaatgggagaattgttcgttgttgtctatagttcttctgttttaccaggaatggtagcatggtttgtaattttgattgctgaattgaaattcagaaaaaataattcacatttaatggctgaacatccatttaagttacctctctacccatattcaaattattttgcatttgcaatgttattagtgattgttgtatttatgtttatcaatccagagacaagaatttctgtaggtgtgggtgctggagttttagtgttagcaagccttgtgtatatgcttaaacatcgtaataaaaagtaattaattggaccattcctttagggatggtctttttattagggcataatattagcttataatgagaaaaaggtgttaattttaagttatagtgtttacgcattaaactatgtaatgtataattaagtctaactggtaaaaagtaagttaaaggagcgagtaaatatgaaaccaattattggaatttctggttctataattattgatgatggcggtatttttccaggctatcgtcggagttatgttaatgacgattatattgattctgtaatccaaaatggtggaatcccttatatcattcctttcaatgaagatgaagaggttgtgaaagagcaacttttaaatgttcaaggattaattttatctggtggtcatgatgtagatcctcataactatggtgaagagcctgaacaaaaattgggagatatttggcctgaaagagataaatttgatatgcgcctcttaaaactagctgaagaaaatggaattccagttttaggaatttgtcgtggagcacaaatcattaatgtatatcatggtggaaccttatatcaggatcttagttatagaaaagaaaaaacgttaaagcatagtcaatgtcagaccccaactttgcttactcatactgtaaaaacaatagcaggtactaagattgcagaattgttaggcaagaaagagatgcaaacaaattctttccaccatcaattaattaaggatgtagcagatgattttaaggtttcagctcgttgtgtagatggggtagtagaggcaattgaaaacgaagatgcatcagttattgcggttcaatggcatcccgaaatgcttcatcgtgtagttccttatcaaaataatctgtttaaatatattattgataatgcaaagaaaaaatagaaagaagttattaatagatgaacgaaaatgaaacaagtaaattaggcttttggtctattgttttgttggccattaattcgattattggctcaggaatatttttaacacctgggagcgtagttcaacaggctggatctaaagctttaattgtatattttatagctgcaatttttgcatctattttagctatttcttttgcagcagcagcaaaatatgtaactaaatctggagcagcttatgcatactcaaaggcagcttttggaaataatgttggtttctatatgggaattttacgttatttttcagctagtgttgcctggggtataatggcagttggggttattaaatctactatttctatttttggtggtaacccaaatgaaacgatgagcgtaactattggttttttgatattaatggctgttattacggtaattaatttatttggtcaaaaagtggttaagtatgttatgaacttagcgactattggtaagttagctgctctagtattaattattgttgcaggggtagttttattaattgtaagtggtgcttcaagtaatttaagtcaggtagatcaaattactcaaaatggtcaaaagattgttcctactttaactactacaggttttgtaatggcaatcgtatctgccttctatgcctttactggatttgaatcagttgcttctggttcagacgatatgaagaatcctgctaaaaacttaccacgcgctattcctttagctattattgttatcgcggtaatttatattggggttgttgctgttgcaatgatgctcgatccaaaagcattaatgacaactaagcaagttgtcgcaattgcggctatttttaagaatgaaattttaagggatgttatcttagttggtgctttagtttcaatgtttggtattaatgttgcttctagttttaatgctccacgaattttagaagctatggcacgtgaaaaccaattttcaaaagctttaactaaaagaaccaagaataattttccaattagaaccttctttatttccgtattatttgcaattttaattccaatggcatttgaatataatatggttaacttgattactttaagtgccatggtacgttttttaggctttattgtagttccattggcagttattcaattctatcgtggaaaaactgcagaaccagttttagatgcgcaaaggaatgtgtggactgatattgtagttccaattctttccattgttctagtgattttcttactagtagaatataactggaaggctcagtttggggtagtcaatgcccaaggacaagtaactggaattaactggtatgcaattgctatgatgatttttggatttatcctcttacctctaattatgtttattatctctagaaaagatcgtaaagctagtaaataacgaaaaagactgctaagccgattggcttagacagtctttttttgtgctatagaatttttatgtcggcagctttacatgattcaatcatttcgggaggccaaatacttgcttggacttcgccaatatgagcttttccaagcaaaagcatacataaacgagattggccaatacccccaccaattgtataaggaagtttaccttctaaaagcattttgtggaaaggtaaatcagatctttcttcagtatgagcttttttgagttgctctttcagcgattcttcgctaactcgaattcccattgaagaaatttctattttacgttttaaaggttcataccaaaatagtaagtcaccgtttaattcccagtcatcgtaatctggtgcacggccatcatgtggcttaccactacgctttaatttatcaccaattttcattaagaatactgcttttttctctttagctattttatcttcacgttcttctggtgctaaatctggccagcggtcttccagttcttgtgtagtaataaaagtaatatcgctaggtaagcggtaagtagaacccggatagcgtgcgctgagctctttttcagtttctttaattgctttaaaaatttgtttgacagtagttttaagagtctcaatatttctttcttctttagcaataatcttttcccagtcccattgatctacgtagattgagtgaaaattatctaaatcttcatcacgccgaattgcgttcatgttagtataaagaccttcatgcattccaaaaccataacgcttaagtgctagacgtttccattttgctaatgagtgtacaacttcgattgtatcatctggcatagccttcatatcaaaagcaaccggacgttcaatcccatttaagttatcatttaatccagtagatttttcaacaaacattggtgctgacattctttgaaggtttaatttgtcagcaattttatcttgaaaattttctctaatgaaaacaattgcggcttcagtatcacgaatggttaaacttggatggtagtccttaggtaatattaatgtcataattatctgtactccttagaaaaattttaagagtaaagaaaaaagcccttcactcctgagtttctcaggacgaaaggcttttttccgcggtaccacctaaattgtctaaaaatagaccagcttaatagaacacaatcatgctcttcggcttgataacgtaccgatgacggcgtagcttactttaatttaggctagcagcacagcggaaaagtgttattcgataattcagggtctactagcttctcactaacgctaattcactgaaagaataaaattatctactcgtctcttcattgctttttaatttttatattaagtatatttaactcgatttgcgttgaaaaagcaagaggtaaaaagataatttttttctagtatgttatgatgaatcttgcataagattaggaaagttggaaaaatatgacaaaaaagagattgtggacgtgcttggcagcattagcctgtgttttttggggcatttcagggttatttgctaagggattatttaatatcagctcaagtataaggccgatttggatttcacaagttcgaatggtagtaagcggagtattattattgatttttgctcaaattactggcaaaagaccacttaaaactatgactgataaaaaagatgcaattactgtcattgcgtacggtttgttggggttattacccgtgcaatattgttactttattgttgtgcaagaagctaatgcgtcaattgctactgtattacagtttattggaccattttttgtcttattttatatggtagtatttgagcaccaggtattacgtgcaatagatgtaatagctgctgttgttgcttttataggagttttctttttagctacacatgggcactttaatcaattgtccctaactccttcagttttattttggggtctaatttcggcagtaggagtagccactaatactctaattccacgacgattacttgatcatacatcaagcttagtggtaacaggatggggcttacttttttcaggtattgctttggtaatagcacatccggtatggccaaaggttccaaataatattaacattttttggctaatggctggtgtgatcgtgattggaactctaattccatttcaatggatgatgggatcacttcgttatatcaaaccatcaactgctagtttattagatgcttttgagccggtttccgcaacgattgggtcagtaattatttttggattagtgatggctccaattgattggattggttcaataatgatcatttgtgcagtattagcacttaattgggaaccgaaaagtcataataaaaaagagtagttactcaaaaatcccgagtaactactcttttttgtaattaattatttcttttactgattttactatgtttatatccatagacgcagtaaataaatagtccaaataagaaccaaacgctagcaaaaatataagttttaacagataaaaaacacatcatgccaatgcaagcaagtccggaaagaattggaattactggatagaatggaaccttgaagtcaccttcaggaatatcttttcttctgcgtaataggataactccaaatgaaacaaaagtgaaggcaagtagtgttccaattgaaactaaactagtaagttcttcaagagaaaagagaccacccataattgcaatcacaatagttacaatccatagggcattttctggaagaccatgcttatcaatttttcctaaaaagctaggtaggagtccatcgcgtccaatggaataaattagacgtgaacttgagtaaatcatggttaacatcattgtactcattccaacaatagcaccaatcgataataaatctgctacccaaccttggttaacgacctttagagcgtaggcaaccggattagctacatctagttgtttataatttaccatcccagttaaaactactgaaactcccatatagagaagagctgctacgattagagtaccgatgattccaataggcatattttttttaggatttttaacttcagctgctgaagatgaaacaacgtcaaaacctaaaaacgcaaaaaagactgttgtagctccacgtaaaacgcctgtagttccatatggcgtgaaaggttgatagtttttaggcttaataaaaaataaaccaacaccaataaaaataaatatgattgctatcttaattaaaacagcagcattattaaatttcatggatgctttcattccacgagaaagtaagattccaattaataaaacactaatgactgcccataaatttaggtacgtaccatttaacggatcgaatggtccctcaaaatgatgcgggatgtgtaagccaaagctgtgtagtaaggagttgaaataagaagcccatccagctgatactgcagcaactgagagcatatattctaagattaatgcccaacctaaaatccagccaataacttctccgtaaaggatatttccgtaggaataagccgagcccgcaacagggatgctagaagagagttcggcataacacatacttgctagcgtacaaactaaagcagcaataagaaatgaaagtgttacaccaggaccagcttctttagcagcaaccgtacctggtaaaataaaaattcctgtcccaataactgctccgataccaatggttaataagtcaaaagccccgagcgttttgacaaagtgcttatcagtaccgagataacgcttgaggctttcttttctaaacggattcaacttcattagcagtacgctccttgtgacgttctaaaatcattttaacaatcgcgtttgccacatttgtgtttcgaagtagcggtccgtgtgaatatgatccaataaagtttttgtagcgtaaaccttcaactttatcttggggattgttgccgtaaccttcaatcatttcaccaaagggatgaagcatattagtattatcaaagtaagtttgtcctgaatgattttcaaaggcttttacttcgccccattcagtcatatagcgggtatcaccaatcattcgcttgtctgccttaaaaattgtatgtaaaggtaagatccctaatcctttgatggtaatgccagagttagttttataataatctcccatcaattgataaccaccacagatacaaagcattggattaccggctttgatatagttttcaattgtttctttatgacgtggcagatctttagctacaacagtttgttcaaagtcttgaccaccaccaaagaataaaaagtcgtagtcattagcatcaaaactatcgtctaatgaaatgttatcaacttcagtttgatagccttgcttatccaataggtaacgaattactttaacatcgccagaatctccgtaagtattcattaaatcttcgtataagtatgcaatttttattgttttatctgccataattatcatccttatttaaattgtatgttcaaagtataacttaaaattgtcttaaatcctagttagtaaaaaatattagttcatttcttcttgagcggctagatggttgattgggccatatttagagccaacatttattggatgtgaaatggcttcataagtaaaatccttagcaattttaacagccgttttgagatcagtccctttagctaattcagctgtaattactgctgataaagtatcaccagttccgttaactcgatctgttttgaaatatggcttagttaaccattcttctgaaccatctgctaataaaaggtagtccttaacttcagtttgattgctattgtggtgactgcccttaattaaaacatttttaacgcccattttttgtagctttcttgcgccttgtttaatttcatcttcattctttagttcaagttcagtcaatttctgagcttcaaaaaagttcggtgtaataattgttgcaaggggaactaattcgtcaagaaaagcttgataggcatcatctgctaaaagtgtagctccatgcttagtgatgattactggatcaagcacaatattttgcatttgataatgttttaagtttttagcaactacatcaataatttctttattagctagcattcctgttttaacggcttttattttaaagtcttcatttaaaacatcaaattgcttttgaataaaatctaatggcattaattgttgtgcaaaaataccttgagaatttcctgcgacagcagctgttaaaagccccattccataaacgccacgtgcataaaaagcatgtaaatctgctggcattccagcacttccgtcgctatcatgacctgcaattgttaaaacttcgatgtgttcttttgacatattgtgccgtccctcctaaaatttattttcggtaaattattactatcaattataaaaaataaactaacaaagtgaaagtgttctgtacgcaaggcagaagggaaaaacttttcctgaacttaaatctcaaatacttaattactgtagaaaatagtctagaatataaactgagagataatatggataataaaggatgaaaagtatggaacataatcgtttagttacctttgatggtactgttaattttcgcgatattggtggctatgaaaataatgaaggtaaacatgttaagtggaataaaatttatcgttctgattccttaagtagtctaactaaatgcgatgaggaaaagttagaagaaatgaaagtcacagtagattgtgatttacgcacaagtaatgaacaattaatggctccggaccgacaatggaatggggtagaagttctcgattgtcatgtctacgcagaggatagcagcggtaattttgttaatgacagtcataaactatatcgctttttacatcatattcctaaagttaatagttatttaggcgaaatttatcaaaatgtaattttaagtcccgctagtcaaaaggcttttgcccgtgtgtttgcgtccctacttaccttaccggaggatgaagcgttagtatatcactgcagtgctggtaaagatagaactggaatgaccacagcattaattttaaagggcctgggtgttgatgagcatacaattgcccgtgactatttattaacaaatgagctgtatacttttggtcttaaaaagcaacttccaagtgattctgaaatgattaaaatggttaatcgcatgaatattactgaaggtgaaggtaccgctattgaaggaattactcagacaatcgatattggatatggcggttttgaaaattactttactaaagaacttggtttttcaaggcaagatctaaaagattttaggaaaatgtatttagagtaacaaaaaacattagacacattgaagtgcctaatgttttttagtttccactagattcacgtttaagtagttctacaggtaaatagtaggtatagttatccagttcttcagttggattatcgattcttttttctaaaagtttaacaagtaattgtgcaattgagggaataggttgaacaattgtagataaacgtggctcgaaatcacggacaattttactaccatcaaagccaataatttttaaatccttaggaatatgaatacctaaatcatgactgatatttaaaataagaagagcagtgaggtcatccgacgcgacgattccatctaccttatgattttctagcaaatctctaattgccatttcttttaaggcgagggtttcgttaaagatcactggatggatgtgttctgttaacttaagctccttaattgtttctttatagcccaggagccgcttttgagtagggtgtccatctaaagtggggtttcctacaaagtaaatgtgacgtgcaccatgattataaagctcttgagtagctaaactaccacctttaaagttatcggcactaacgattggaatattatccgatagttttcgatcaaaagatacaattggtaagccagttctttgatattcttcaattcctaagttatgtgcaccagcgataataccatcaacttggttagccattaacatttgcaggtaagtacgctctttttctttgtcattgcctgcgttacaaagaattgttttatagccgtgtttaaaaagttgatcttctattttagaaactaattctccaaaaaaaggattagaaacatcaggaaaaattaaaccaattaatttggttttcttgccttgcagagatcgagcaactgaattaggttgataattcaactctttcattgcttcatgaacttttttacgtgttttttgactaatatagccgtaattattaattacgcgtgaaactgtagtaacagagcagcctgctttggcagctacatcggttaatttgaccattattatcttcctataatatagaattcatgctccatagtcgtcccgtgtacttagtatctttgtcaaaagcaattttttggtttggagttggtgcaaagaatcttaaagttgcaacatgacgaccattattgatgaaaatttcgcataatgagccatcgatgaaaatatctaaatctagatcttgatcatctttcaggtcaattgttctagttgctccataatctgggttaacagctggaccacttgaagcccgatcaattgttaattttgcgtttttatctgtattaaaatcaagtactagacttgatgatagatcttcattagaagctaagtgtaattttccactttgaccggctagtaagtgaagtttcagttcatattgcttaccggctgcttgactaattatcttttcattattgagctgtttctcattatgacgtaatttcttaattgcgtctactggatgttgatataacgccccatctttaatttctaatcgcttaacttgactgtagcaattagcccagttctctttatcggttggataagtacagtctggaagaccaacccaagaaatagcataagcatttccatctggtgcgttaaatgcttgagtggcatagacatcaaagccatcatctaaattagctggtttttcttgaagaggggcaaatttcgcttcacttaagttaatatcttttccaatccagtacatatttggatagatatttttgtagtcggcaactgacttgtctaatccttgagggcagaaaattaaaacaggataattattaataaaaactaggttaggacattcaatcatatagcccatttcgtctttgcctaagtctaagtagccattttcatgccaatttttgagatcagttgattcatagatatcaatgtgacccttcttagtcttagcatcttgagccccaagtaaaacataatattttccatcatgctcaaataattgtggatcacggaagtgctcactgacatggtctggaggcaggattgcggggtccttaggtttagtaatatgattatctttatccatttccgcaattacttgataaggaattctagtccaatctttatcgcggtgattgcctgtatacattaatagaagttttccatcatgttccattgctgaacctgagtaggcacctgcattatctaagtcactgtctggatcaattgctgaaccaagataatgccaatgcactaagtccggcgaagcatagtgaatccaagatttaactccatgaactggtccaaatggataagactgacaaaatagatggtattcaccattataataggaaaatccattgggatcattgattaatccagaaagtgggtggatatgatagtgcatttgatagggagacgttgcagcttgagcttgaagatttaataaagtctgtgcatcccaatctttgtatttgcgataacgttgttctcttgtccattccataacttattcacctcattgaatatgtaaacgcattcttatataagaatgttaacttaaagctggtctatatgtcaaacgaataacagtattaaactagtattttaaaaaatagaaattaaaatgtggcaaaataatagcattttttatgataagcgcttgacataattttagaatacgctatcataatacatgtaaatatttaaaacgcttacacattttcaaggaggagacagacatggatcacaaaaaagttgctgaagcagttattgaagctgttggtcgcgacaacttagtagccgctgctcactgtgctacgcgtctacgtttagtcttaaaagacgatagtaaagtaaatatgaaaatgcttgatagcgatccagatatcaagggtacttttaaaactaacggtcagtttcaaattattattgggcctggggatgttaataacgtctacgatgaattaattaaaatgacaggtctatcagagctttcaactgatgatttaaagaaggttgctcaaaaggatcaaaagtttaacccagtaatggcatttatcaagcttttatctgatatctttgttcctattattccagccctagtagctggtggtttattgatggctttgaacaacttcttaacttctccaggattatttggagctaagtcagttgttcaaatggcgcctaatgttaaaggattatctgaaattattcaggtaatgtccgctgctccatttattttcatgcctatcttagttggtatgtctgctgctaaacgttttggagctaaccaattcttgggtgcaactattggtatgattatgactactcccgctttaggtggagcaggtaagtactgggatatctttggtttacatgtttctcaaactaactaccaataccaagttattccggtcttagtagcagtttggcttttagctttcttagaaaagagattccacaagtggttaccatctgcagttgacttcacattcacaccacttctttcaattatgattactggtttcttgactttcacaattattggaccagtctttaaaggtgtgtcagatgcaattactgctgccattgtttggttatacaacacaactggtgcctttggtatgggtatctttggtttatcttactcagctattgttactactggtcttcaccaaagtttcccagcagttgaaactcaacttttagctgaatatgcacgtggtcgtggatccggtgactttatctttgttaccgcatgtatggctaacgttgctcaaggtgctgctacatttgctatttacttcttaactaagaatgaaaaagttaaaggtttagcaagttcatctggtgtttctgcattacttggtattaccgaaccagcattgtttggtgttaacttgaagtacaagttcccattcttctgtgctttaattggtgcaggtgttggtgctgcttttgcaggattaatgcatgttactgctgctgctcttggttcagctggtttccttggtttcttatcaatggtgccaaagagcattccaatgtgggcactctcggtagtaattagttttattgttgcttttggtttaacctttgtatacggtaaacgtcactttaaagaagacgtagttgaagaatctggtactgttgaatctgctggtgatcaagtagcacaacaagaaaaagctgaacaaattatcaaagaagataaagaattacatgatgaagtaattgctgctcctgtttcaggtaaagcagaaagcttgaaagatgtaaatgacccagtcttctctactgaagcaatgggtaagggtgctgcaatggtaccaagtgaaggtactatctactccccagtaactggtgaaattacagttgcttatgaaactaagcatgcttatggaattaaatcagacgaaggtgcagaagttctaattcacattggtatcgatactgtaaacatgaagggtgaaggatttactactgatgtaaaacaaggccaacatgttgaaaagggtgaaaaacttggaacagttgatttagatgctgtaaagaaagcaggatacgatacaactgtcatgactgtaattactaacactactagctatgcaaatgttcaacgtattgatggcgtagaaaagaagcatggtgacgacttaatcgcagttactaagagataattattgataagtaaatcaaaataagctcatttcctactttggggatgagcttatttttttgtttgagataaaatatagtatgagattaaataaattaatggaaaggtttaaaaattgtgactaatcttcacgtaatccaagcagatatcacaaaattaaaagtcgacgtaattgttaacgctgctaatcgtactcttttaggcggtggaggggtagacggtgctattcaccgggctgctggcccagaattactggcagagtgtcgaactctcaagggatgcgatactggggaagcaaagataactaaaggctacaatttaccagctaaatatgttattcacactgtaggaccagtttataatccgaattttgctcaaaaagatgcagaacttttagcaaattgttaccgcaatagtctcgatctggctaaaaagtataaattacattcaattgctttttcttgtatttcaactggtgtatacggctatccaaaagaagaagctgctaaaatagctgttaaaactacaagaagctggcttaaacaacaaaaattcaatattaaggtctacttttgtgtatttgattcagaaaataaagccatatataataaactaacgtcttaactaaagtgaggagttttagatgagtttaaaatatgcaaaacgaagtcaggtgatttggtttgcgatcttggctgcaataaaggcttgtaatatcttatttgtggcttatatgatcaagattatgctgaatgtggcatcatcgcattcaaaggatgtaatgcatttagtgcgtttagcagctttaacggctttagggcagctctgtttcatgatgagtaatttcatctatgagcgtgtaaagatgggaatcattcgtgatgttaatatggttttcaagcaggctaatttacaatatttggttgatcaaggggaaaccgatataaaaaatggcttgtcacttatgacgaatgacctaaaacaaattgaaacaaatcgaattacagctcaacttgatatgatttatcagggcttaacttttattggatcattagcttttgccttatataattcttggcaaatgactattcttttcgtagttgcgatggcggctccagctgttgtacaaatttttactagtagaattattaccaaaaaatctaaaatttgggctaaaacaaatgctaattatactcagaatgtttctgattcattaaatggggctcaatcagctaagctctataatgttagagataatattgtcgtaagagcaacaaaatcagctcaaaatatggaaaatgctctgcgaaatatgaacttaactcaagcttgggccttagaattaatttattctgctgctgaattattctgtttcattattccatgtacgattggtggcataatgatgatgcagggaagcttaagtgttggtactttatttatgatggtagatttggcaatgaactttattacgccagtcgtaaccttgtttaatgaatttaaccaagttaaatcaaccgttccaatgtggaagaaaacacaaaaagcccttaattatgaaataaaagaaaattcagagaaagccaagaagtttgaaggactagatgtaaaaaatctttcgtatcaaactaaggcagataagcatacaatttttacagatgttaatttacaggttaaacctggagaaaagattcttctcatggctccaagtggttggggcaaaaccactttgctgcgcctaatgcttggtttaaagaagccagtaaagggtaaaattttgattaacggaaagaatgtaactggggactgggcaaaagctcataattatttctcttatgttaatcaaaaaccttttatgttcgatgatacgttgtggttcaatattaccttaggtagaaaggttagcgacgaaaaattaaaggaagttattcatctagctggtttagatgaattagttaaaaaagaggggcttgaccataaagttggcgaagctggcaatggtttatcaggtggacaaatccaacgaattgaaattgctcgtgccttattgtcagggcgaccaattttgttagctgatgaagctacgagtgctctagatccgaacttgtctctagcaatccatgaaactcttttgaaaaatcctgatgttgcagtaattgaagttgctcacaaaatttcaccaaaagaaaaagcgatgtttaataaaattgttcacttagacatgagtgaaggaagtaaaaacaaaaataattaaaaaataagcttgagaagttttatacctctcaagcttatttctttagtttaattttgcaaaaaagttagtaaaaattttttcttgcttcggatcgttcaatagcttatctggtcgccattgaatacctaacattgtttgatcagttgattcaatagcttcaataataccatcaggagcagttgcaacaatattaaagttgttagcaatagtcttaatagcttgatggtggttgctattaacatagggatgagttcctacagctttagcaagttcactttcatcagttacattaacgtggtgactttctaaagagagatcatttggctgaatatgttgaacacctgcaccagaattttgagcataaatatcttggaaaagtgtaccgttaaaagcaacatttaacatttgcattccgcggccaattcctaaaattggtaaattggaatcatgggcatttttgattaagtttagctcaaattgatctcgatgtggatcagtttctctaagctcgggaagtggctcttcattataaaaaattggtgtgatgtcagggccgtcgctaagaatcagagcatcgaaattgacactaggcactggcatcgtctttaagcttactggagcaaagacaagaggaagaaatcctagttttacaacagtatcaacaacacttcgatcaacaattacctcattatttttaatacctgcactaataccgatagttttcataaagaaacactcctttaacaagttaggcgttgcgagattgggaagaaaattgcatgattaaataattaatcagtagggtaatcccagttgctgcaaatacccattcataagtaaacataccagaaatagttgaacctagtaaagaccctaagaccgccccaactgcttggaaggattggttgtaagaaaagaccctaccaaatgcttctggtggaacattcaaagtaagaattgtttgagcagctggcagtaagccagcactgataattcctaataagaaacgccagaaagctaatgaccaggcattaggaataaaagtcattggaataaataaaatagtagcaattaataatccccatcgcaaaactttttcagcaccaacacgatccattaagtgaccaatatgtgatgcagagagcattgtaccaagaccgggtgtagccgcaacaatcccggcgattagggcaatattattactgtgcggcattaaagatttaacataaagagagacaatgggatcgatagacatagttgaagattgaacaatcattgtcgtcacaaacataatgataattaatttaacattaggtaagtcttgcagtatttgtcccattggtttcatcttttctcgggaaactggcgtgaagtcttcttttactaataaccatgttcctaagaaagttaaaaacattagtccgccagtaataaagaaggggatgcgataaccgaaggcgcttgataaggcaccaccaattagaggtcccactaagttacccgcagttcctgcagtcatcatttgactcattacccagccactacgctggtgcggtgtctcacctgccatgagcgccgttgcgttattaatatagcctgaaataagccttgtaagaaacgcatacagataataaaaagtgcactttgagctaggcctgtaataaagatcgttaaactcataacgccagcagcacgcatgcacattaattttctacctttacgatcggctaaattaccccagtaaggggaaataatggcctgggcaataaaagtcatggcaaatgctaaccctgagtaaaggtttaattgtagtttattataatgacctagttcagccataaataaagaaataaatggcattgtcattgaataacctaatcctgtaataaaacaaccgagccatagagtataaaaagttttatgccaaccatttggtaaagtgctggcttgtgatttattcacctagtcatctcaattctaaattactttttaatttataataggattattttagcacagtgttttaaaagtaattattttcatcttattaacttgtttaattttcttaaaaaagtaatgcggatagtcttctaacatgctaatattgattagcacaataaggtaaaggtagagaatagtgaataagatggaagattctaaagataagaaaaaagttttaactagagaagagtatcgaaagcgactagcaagccatggtaaagtaaacgtttgggacttattcttaaatcggccatacatttcagtagctttaattgtgctagcaattctatttattatgaccaagtggtggcttggtctagtaattttaataattgctgcaattgctggagcatttatcattgtaaaaagtaaaaatcctgacagaactcttagtttggaatttaaattaggtgggaataagacacttcatttacttaaagcattgcagttaggagcttcaatgatcatgtttttgtccacttatatgcgacaagttgttactattaattttcaaactactggctcacaagatatgttaaaaatgctccaaggtgcggctgctagcaccaataatgtttatgcggctcaaggagcaaatgtagttggattactggatagcttattaggcggtagtttgtgggggacctaccgctatgcgacaaatagtggtcaatttatgaatgatccggcaggtagatggattatgatttggaccttccttttaatggtagcccctgctatttgtgttttggcacaattctttagagaaccgtattcacgtcgagctatgctagtggggtcaggtatttcaacagttttatttgttttgacgccaactatgattaatcgatgggcatatcaatttgccattaatcaccaaattaatccagcacagattggtcaaatgtttagtgttggctatatggcctattttggcatgggatgtagtattctagtatttgtaattgctattattcgcagcattaaacgagataaattttaatgaatgaagataaaattgctactataatttaggtagcaattttttatttggagaaaaaagatgagttttgatcaaagaaaagtagaaattaacaagcaaatgattttaatgcccattaatactggtgtaagtgaaaaagatattttaaagcaagcagaggaaataaaaaaactccaacctgagatgatggagtggagaattgattattttaaagacgtagttttaatgaacaggttacttgaagtggcaggaaaagtgaaaaatgtgatggggactattcctattttaattacatttcgtagccaaaaattcggcggcaaaactgaattagatagtgaagatgcatatttaaacttagtaaaaatcgtaattgattttaaattaggatatgctgttgatatcgagcaagggcacgtttctgatagagtaaaaggtttaattgaagatgcaaaatctaaggaagtccaagtggtacttttttagataaaaaaactctttcggaaaagtgaccgaaagagtaaagttaaggaaagctacaaaatgttatatgaaagcgctttaaccgccttcatagattattatagtagagtgtgagctgaagtgcaaatgtttttttcagagatgaggaataaatttgaataacgatccacttatatttgaatttgcgatagctaaagataaaccatccagttttaatggtagtaaggatactacctgtcctttttgtgatgtggaaaatttaagggatatttatcaaaccaatggtccaatgatctggctggctaatcgttttccaactttaaaagatacaaaacaaacagtattaattgaatcagatgaacatcatggggatgttgctacatattcacaagaatataatcgccgcttaatgaagtttgctcttgaatgtttcgacaagatgaggaaaaacagagaattcagatcagttctttggtataaaaattttggacctaagtctaatggatcactgtctcatccacatatgcaaattgttggtttgtataaagaagatggctataaatatattcatgaaaataattttactggaattactgtttttaagacaaataatatggaagttaatttcgcgacacatccagttcaaggctttcaagaattaaatgttaatttaatagataaaaacggcttaaatctttgggcggattggattcaatacgctatccgttatactttagaagagatgtatgggggaaaatgtgattcatataacctatttttctatcccaataaagacggaatctgttgtaaaattatcccacgtttttatgcgccgccttattttgtaggatataaattatctgagtgtaatgataataacaccttgagaaaagaagcgaagagattattaaattttgtacaaaaatcttgaaataatatttcagtaccttagaatgttgaatagaaatagaggtacgttatggatttatctactaaagttttaaacaattatcctaattttaagggagcatctaaaaagattgccgattatttattggctcatccaaagacttttttacaagaagatgcacaaggcttgggaaaaattactaaaactagtgctgcttcgatgattcgtttttgtcaacaattggggtttaagggcttaaaggattttcaaattcaacttgctcaagatacaccacaagaaagtgaaaatacaattgaaccgattgtggataatcatgataatccacatatcgttttacaaaaacttctgtcaagtattgaacataatactgaaaaaacagctcatttgattgatggaatggccttaaatcaagcgatcaattttttgaaaaatgctgatcgaatctatttagccggtgttggtgcctccagcttacctgctcaagatctttactataaatttattcgtagtgataaaaatgtcatttttaatcaagatattcatattgccttagagagaatttgttattcccattcgacagatgttttggttattttctcttatagtggcctgactcaagaaatattattacttgctgaacaagcacgtaagaatcatactccgattattgcggtgactcgttctcatcagtctcccttggttgaagtcagtgatgtagttttaggtgtatcaacagatgaaaagctgcttagagtaggtgcgataaattcacttttttctgaagtatttgtctcaagtgtcttatttttagcaacgattaatcaagatttacctagattagaagaaaagtttaaagaaacagaactagtaactaatcaattaaagaaattagatgagtagtattctaataatgaattaaataaagaacgtaacctactagaaaagatgcacttaagcatctttttcttttgaaattaaaagctatcttgatataggataataaaaagttttaaaataactttataataaaagatactgatataatatataagataacgtaagttaagttttgtctaattctaataagaaaggcgattgctttatgttaaagggtagaattactgacattatccaaaagtatgatattgatgcaggtgtaattgttaagtatggcgatcaaattatgtatcaacatcaagctgagaaaatttttccagcaggaagtttgattgacttagctattgctgcatatattgaagatcagtggaaaaagacccctgaagttgtggatgaaaaaatggaagttactgatctttctcgtgtgcgtggcgctggtattattggtgatttacgtcgtactaattggagcgttcgagacctagtttatttaactagtgcactatcagataatgtagctactaatctattaattgagaaatttgatatttatgaaattgatgagtggttaaaacagaattatcccggcatccgattgggaagagagttaatgcgctattcggctaacgatcaagataacgaatgtacagctgctagtgttgataagttgattacacatttaatgactactcagaatctcttctgtgctttagtgcgtaaaggattgagtaatcatactattccaacagatttaactttttatggggagaatcttcttacctacaataaattgggccgagatcgtcaggcatgccatgaggtttgtgcttttatgacaaaaaaagcaccagtattttgcacggttttgagcagttatgagggaagaaatataggggatagattattcttccaagaattaagtaagttgattttttcacatgtgaaaagtgctgactttgaaaaataggaatcctaagaatagataaggattcctattttttataaactaaattgcaagggtagaaaatagtgagcggaggaacaatttttgaaaaatatttttcgaaaaatagatatgtattctaaaaattttagaatacattggctagagtatgtcgctttgtttatcggaatagatatttttacgcagatgctaatcattccgttattcaggtatgtaacaactggaattttaaaagctagtgcaattccgtttgtttcatatcaaaacattgttaccattattaccacgcatactggagttgctctcctactaatcgtggaattagttatcctgcttttagtaatttatggtgtatttgccttaatattattgggaattagagaaatttctcagaatcaattttcccttaaattactatttaaagaattatggcagacatatcgttccgttcgagtagggtccatcttattactaggcctatatttcttattaattgtaccttttgcagatatggtttatcgaacgccgttattagccaaagttcaaattccagaatttattttggattttatgactagaaatatttggctggttagtggattgataattttttatttgctagcttttatttttggtatcagattgattctgacgcttcccttgatgatttatcaagaaaaaaagacatggattgcgatgaaagaaagctggaagttaactagccacaaaaattggtggaccctcttaagtagcttattagttgcaggaatctgtgtgagcgtaattttagttagctgcaatttaataatttatttctgtcaattgggattagatcatttgccagaaaagcttagctttagttttgctatctttaatctgttactggtccaagtaattagtgaattaatggcgatttggattagtgttatttctattttaattgtcgtcacaccgttaaatagttttaagtgggaagatcagaaaaaagtaaaaagtaaaaagacaattaaaatagtagattcctgcttaataatcgtttttgtattagctgcaggaatcaatagtgccttgtatttaaagggagcagatatgcagcgcccagtcactatttcacacagaggagtaagtgataaaaatggagttcaaaatactatcccagctctagaaaagacagcaaaacttcatccagattatgtggaaatagacttgcatgaaacaaaagataatcagtttgtagttatgcatgacgaaaatctgaaagagttagctggtattaataaaactccaaaagatttaactttaaagcagttgaccagaattacgcttcatgaagatgggcaccaagctaaaatcgccagttttgatcaatacctaaaagctgctaagaaattaaatcaaaaattattaatcgaagttaagacaacgcctaatgattctccaaaaatgctccagaattttaatcaaaaatatggcaagctaattattaagcgtaaatatcaagttcagtcattagattatcgtgttattgaaggattacatcaaattaaccctaagctatttgtcttgtatatccagccctataattttacttatccccaaagtgttgcagatgggtattcaatggaatattctactctaaacaatgattttatatggcaggctcaacttcagaataagctggtgtatgcttggacagttaatagtccacaaatgatgatgaagatgatgtatgacaatgtcaatggaattatcaccgatcgactagctgaattaaatgagacagttaaagattttgaagataatcgtagttacgctaataagctattaaactttattttaatattgcctgatgataataaataattaagtgtaaagcatcccttactgggatgcttttttacatagaagaaaatgcttatattttgataaagaaagcgcttcatgataaaataggtatataccaattattaaagaatagttaaaaactattaataaaagggggattataaagatgagtgatagatcaaatgcagtcaacgcatgggtaaacaaaaatataatgcctattgcagcaaaaattggtgcctttaagccattgattgccattcgtgatggaattgcaatggctatgccactgatcattgtaggttcattatttatggttattaatggttttccaatcaccgcatggaccaactttttaactaaaactgctgttcatggagtgagtttgtcacagattctggttaaagtaagcaatggatctttcggaattatgggattaattgcagcttttggaattgcatggagctatgctaatcaatataaaacggatggcgtttctgctgggattatctcagcgtcagttttctttattgtgacaccaagtattatgagtggaggaaagactcctgctgaaggctttccatatgtttatcttggaagccgtggattgtttgtagcaatctttttaggtttacttagcgcttggatttttcaatggtttattaatcataatattcagattaaaatgcctgatacagttccacctgcagtcgcaaagagcttctctgccttaattccaggtacagtttgtatctttttagcaggatgtatctactggctattttcatgggcccactggggtaacttacatgatgtaatcatgaatattctagccaagccattaggattattaggtaataccttactgggaactttagcatcaattattttggtaagtttattctggtttgtcggtattcatggaggaaacgtagtcaatacggctatgtctccaatctggttaatgcaaaccgatgctaatagagtgctgaatcaatcagggaaattagatttagcccatggtggtaatattattactcagccatttatcgataattttgtatatatgggcggagcaggtgctactttaggattagttttatgtgtgggttatttagtttggaaaaaacgtgcaagtaaacaaaatgaaattttggctccattaactattgttccaggaatttttaatattaatgagcctactatgtttggtttgccagtagttttgaacctaagcttaattattccgtttattattgcacctatgtttaatgctattactacttatacagcaatgaaattgggctgggtgccactatgtaacggaacggttattccatggacaatgccgccgcttatttcaggatttttggcaactaatagtattgccggctcaatcttgcagctgtttaatatcattgttgatattttgatttacttaccatttatgagtgctctaaataaacggcaaattgttgaagaaagtagaaagggttagaaatatggttacgagaataattagtgcaaatactagcgaaattttaaaaatggacggtactcaattaaaacaaagtatcaaggctagtgaaggtcgaactgttttaagtgaaaatgtggttactgagccagcaattgataatctaactacttcagaaattgcggccgcttttggagcagacttaattttattaaatctatttgataccttaaatcctaaagtaagcggcttggaagtggataaaccagaaaatacggttaaaaaacttcaaaaattaactggacgcccaattggagtaaacttggagccagttgatgagaaagcagagatggaatcaactaaattgcagatttcttctggtagaactgcaaatgttgaatcaatgagagcagctgaagagttaggattcaatttcgtttgttttactggaaatcctgggactggtgtaactaatagaatgatcgctaaagctgtaaaaacagctaagaaaaatttttcaggtttaattattgctggaaaaatgcatggagctggcgtggatgaaccagtagccagtgaagaatcagttaaagagtttttggatgcaggtgcagacgttattttggttcctgctgttggaacagttccaggttttactagtgaagaattaattaatatagtaaaaattgttcataaacatggtggactagtaatgagcacgattggaactagtcaagaaagttctggagctcaaacagtccatgatattgccttacaaaataaaatttgcggtattgatatccaacatattggagatgcaggttggggagtagtgccaccaacggatactattttcgaattaagtaagacaattcgtgggatgaatcatacaatttcccggatggcacgttcaattaatcggtaaaaagataataaataatatataaaaagaagatatcttagcaaaagttactttgatatcttctttgtttttaatattcagttttacctaaatcatcttctgggcggtggagctgtagacgcaagccgtagacagaaaattcttcaccgtcttcttggcggttaagtttaatacgtaaatggtctccatcttgttcgaactccacttcatttctagtgtcaatccaagctgcctcttcaacgtgaggaacatgctttaattcgatactttcttcaagtggaatatggatgaaaacatagcgttgatatttagcaatggcattataaaagacatgaacattgtcttcatctgcctttatctcatggtcagcccgactttcatagtaagcatgtccaaagcgactaatccaattacgcaaagttttcattgcaggatctgattcggctttaattgatccatcggcgtttaattcaacttcgaaatagatattcatatcgtctaatctagcagcgattaattttgctagaacatcaggagaaattaatttttctgctggtcttttttgacaaaatttaattgtatatttttgacaagctgcttgcaggtctgccatttgttcatcattagcgtctttgatacttacgcctctaaagccgcagtctcgtgcatgacgtacaagagcatcggcatcaattacaccttttggagcaacttgatactgcaatacaagtccaatatttaaatcttctttttcactcattttactattcgctttctatgtcatattcaagattgattataagtggaaaagaaattttaagcaaagcaaaatggtttcacgtataattagggaggactatagaagggacaaaaaatgattatttttaatattattttatatattaccattggtttcattgtttattttggttaccaaactgtgcttcattatcataaacatgaaaatgttaattttctccgtggcttaattatcagtacgcttgttttagcagtgctagtttctttacaaatttactgggcactccctaatattattggcctatttttatggctatttattatgttcttgtttattagtgtggctgctagtgctagatatattaccgctagcttgcaggataagaaaaaaagaaagatagagctaattgcttctgctgctttggcagttattagcttgattgctttatttatcgtggttgccaatgtcagataataatataaaaataattattgctccagctaaaaagatgagagttgatcaagatacttttttggttaaatcagagcctgcttttttagataagactcaggagctattagactttttaaaaacaagaagttttaaccagttacaagacttatggaaggcgaatgataacattgttcgtacaaatcaacataatcttgtaacaagtgaacttgattctaacttaaccccagcacttttagctttttcaggaattcaatatcagtatttagctggggatgttttaccgcaagaaggattagactatcttcaagatcatttgcgtattttgtcaggcttttacggtattttgagaccttttgatgggataattccctatcgtttggaattaaaaactcaaatgactggctttaaatactacagtctctataacttttggaaagatcttccgtatcaagagctttttgccgatacagatacagttattaacttagcgtctttagaatattcgcgtttgatttctccatatttaaaggatagtcaaaaaatgattacaattaagtttttggaaaataaaaacggaaaatggagacaaagtgctacacatgctaagatggcgcgaggagagatggttcgctttgcggccaaagaaggaattaatagaccggaagatttaaaagaattttctgattttggctatgttttttcagcagcagattccacaaaggaaaattatatatttaagaaattgtagaaaaaaagagaaatcagacgatttctctttttctatataaattaaaacgcattattattctgtaaaaaatctgttgttaaattaacagcatttttttgatagctatcactaaaacaatggtctgcaccttcgattaagtgtaaagtgctgttttgataaatttgatcgtatttctttgaggcattaggggaaacaacggtatcatctgtaccgtggattaaacagacaggtttagtaaattgagcagatacttcataaataggcaattgttgagcaatgcgtaaataaaatccgcctagggttaaatctttaaaaggaaggcggtctgggatatggtctggattataggtaactccttgtgtattaccttcaagagcatcactttttaaagtggcagctggtgctagcagtactaccttttttatcagatcaggataaagcccagctaacattgaagcaacgacaccaccttgagaatggccgactagataaatattacgtacatgcggatctgttttaacgtaatttaaaatggcatttgcatcttcaatttcatttaaaacagtcatattttcaaatttaccatctgaatcaccatggccattaaaatcaaagcgaacactagcaatattttcatcacgaagactgttagcaatttcttttagcaaagaagtattacggttagcggtaaaaccatgaaaaatgattgccatgtcatatatttctccgaaaggttcttcccgagttccaactaattgtaatccatcacgctcaagtgtaattgttgccatattaatgcctactttctttttgtctaactttattatagtctgacatgtgagataatttagtagcttaataaatttttagtataatattttcttggataaaatataaaggattgtgatgaaatggatctgttattagtaagacatggggttagtgaacataatacttcagatgtgatctccggcggtactagtaaccctaacttaagccaagcgggtgttaaacaagtagaagaagtaagtaagttaattgacaatagtaaacttgatcgagtatatgcaagcccattaattagagctaaaagaacagcacaaattttaactgattttcaaaaagagattattactgatgatcgacttagagaaatgaattttggctcttgggacggccaacatgccgaagagctgaagataaaatatcctgatgccttcgatgatttaggaactattaatagtaaatatgcagaatacgctgaaaatggtgaaacttttagtcaagtagcagatcgagttgaagaatttttatctgagattcaacccgatgctaatgacaagacaattatgattgtttgtcacggatttgtgattaggagtttaatagctcggtggtttaaactaaaaattgaagatgtaatgacagtaagaaatgttagttttactgagcttcattttgaaaaaaatgatattgagcgaccaagattaatgacctttaatcggacggaacccttgtattacggaattaagaggtgatatgttatgcgagtagtaattttacgtcatggaactactgaattaaataagcaaggaatgattcaaggatcaaatgttgatcctgatttaagtaaagaagggcgcgcttacgcagaaaaagctgctaagaattttgatcctagtcaatttgatgcagtatatgcaagtccattaaagagagcgcagcaaactgcaaggatttttgtgggggataagaccccaataataaccgataagcgaattgaagaactaagttatggttcttgggatggaaaatcttctttagaatatcgtaaaaagcatccagatgcttttaatagcaaaggactaattaacgataatatttataagtatgcttcagatgtagaaaagcgtgaagattttagaaaaagaattgctgcattttttgacgatttatataaagaacatgctaatgatacagttttggtagtttgtcatggtgtagtaagtcggatgatttgtgctcattttttaactaatggcgatattaagtattttgaccaaatgcagaattgcggtctagctgaattagacattaataaagaatatggaactttggtttactataaccgcgtcttagcataataattttaaggcttgattttgatattttatcgaaattaagcattttttatatctatatgttgacacggtgtcactttaggaatagacttaagacacatcgaaagtgacacagtgtcacaaggagggaaggcatggttagtgaaacttttataaatctttcggatgaaaagaaacaaaagattgaaggagcgcttttaaaagaatttagtacttatcccttagctaaagcgcaagttgcacgcattgtaaaggatccggggattgctagaggagcattttataagtattttggtgatttgaaagattcatatatttatctctatagtcttgcgatgaaagacgtccatatgggacctccagcaaggttgagagagtttgaccctgaagctttttataagatgacagttgattttattaatcagactgagaatagtatctattttgatctaatcaaactacatcttagtcagaatcaagcttttcttggagatgataaaaagcagaaggatgcttttcttaatctcgactctcaagtctgggctgccatggttttaactcatgaggcaatagatttagccctatttgataaaaagaataaagaaaaaattctaaaaagataccatgaaagtttatgtttattacaaaggaagtaggcaaaaatgtttttagctctaaaagaaataaaatacgagaagctgcgttacggcttaattacattgatgatttttttaatcgcatatttaatttttatgctgtcatcattgtcagtaggtctagcttcagaaaatacacaagcagttaatagctggcaaactcaatcggttgttttgaatgacaattcgaatgtaagtttaagtcagtctctgctaaccaaagaaaatctaaaagattttaaaaagacaaagaatgatagctatatcgggatagttccaattgtaatgaaagaaaagaaacatcaaacagtttcagctcaatttattggattgaataaagatgaatatatctataaaaatctagaagtagtttctggtcgtaaagcaaagcacaatgacgaaatagctgttgatcaaattctttggaatagaggttaccgcttaggcgataaagtaaccctaaatggtagcgatcaaaagtataaaattgttggtttcttaaaaaatgccaagattaatattgcgccaattgcttatggtacgatggcaacctggaagaagttaagaccaatggctccgaatgttgaagcttctggaattatctctaagaagaacttagattttaaagctaagaatgttagatcttatgataagcagacttttgttaataaattacctggttatacagcccaaaactcaacttttgaattaatgattggttttctattcgtaatttcgttgattgtgattgcagtatttttatacattttaactattcaaaaaatgccaaattatgctgttttaagagcacaaggtatcccaagcaagactttaattggtgctactcttagtcaatcattaattttagtaattttgggtacggtcttagcatatcttttaatgctgcttactgttagcgtaatgccagctactgtaccaatcgattttgccccatggatcatgatttcaacctttgccgggatgattgtaatgggagtaataggtggattaattccaattcgatcaattcttaaggttgacccttcaaaagctgtgtaagggaggaaatttatatgtcagtaattgaattaaaagatgtaagtaaatcctatggtcaaggagaggccaaggttaatgctctaaaaaatataaattttgaagctcaaaaaggtgaggttgtcttaattgaaggaccttctggagcgggcaagagtacttttctaacaattgcaggagcactgcaaaagcctacttctggtgaagtatttattggaggagataacgtaactaactattctcctaaacaagctgatgcattacgtctagataaaattggctttgtcttacaggcttataatttagttccttatttgactgttcgggaacagttcatcttagtagataaggttaaaaagaccggcaatctaagtaaagaagcgcttgatggattgctagatgaattaggaatttctcaactggtaaataaatatcctaaggaattgtcaggtgggcagcagcaaagagtggcaattgcgagagcattatatgccgatccagccattattttagctgatgaacctactgcttcattagatagtgaaaaggttgaagaagtaggaaaactatttaagactttagctaaacaaaaagaaaaggctattattctagttacccatgatttaagactgaataagtattcagataagatttatgaaatgttagatggacgtttgagcttgaaaaaaggtaattaagtattgaataataataaagaaagcgatatcatatagttgaaaagtgaataaagtgagattgtaacaatattttgcacaaaacccacttgtctctagtttaagaagggataagtgggcttttttgtatgtttaaggaggcacgatgaaaataataagagttttaaataatagtgctgttattattgaaaaccaagagcatgaggagataattgcacttggtaaaggaattgcttatggaaaaaaagcgggggatgagtttgataaacaaaaaatatataaaattttcacacccttgtctgacaatcaaagaaaactgctattagaaacaattcatgaaacagatcctattttctttcaaattgcacaaaaaattgttgatagattgaaatttgaagaaagtattgaactggctgatagcgtatatataactttgacagatcacttagctacaagtgtagaaagagcgaagaagggattgtatttaaacaataaatttatttgggaagtaaaaaattattatccaaaagaatatcaatatggtttatgggctttaaagttgttagacgctcaatttgatttgagttttccagaagacgaagctggatttattgcagtacatatcattagtggggagctaggaaatgatattagtgattttagtaaatcagtagattttatcaaatcaattactaaaattgttagatattattttcacattaatattgattaccaatctttgaactataaccgctttgcggtccacttgaaattcttttggaaagctatgatgtataaaaaggatcaatctagttttggagatttgagccaagaaattttaaatgtaataaaaaatagcgatattgaagcatataaatgtgctttgaagattaaggaatatattttagaaaaatataattatgaactaaacaatgaagagattatgtatttagcaatacacattaataaaattgtgagtggagaagaaaaatgagctatgaaaatatgaataagcagattatagctgctgttggaggagaagataatattcagtctgttgttcactgtgcgacaagactaagatttgttctaaaagatgaaagtaaagcagatgatgcggcagctgcacgaattcctggagtattgcaagtagtaaaaaaagcaggacaatatcaattagttattggtagtacagttgaagatgtttataacgatttagttaagatgattaacatcgaaaatgatgatagttataagtcaacacctaaagaaaagaagaatatttttgatactgtaattagtgtgattactggatcaattgctcctgctatcccattacttgctggagccggaatgggaaaagttttgcttttgattttgacaattagcggtttgttgtcagataaaagccaaacttatcaaatattaaatttaatttttgataccggctatttctttatgccagcgtttattggattttcagccgctaaggtttttaatactgatcaatatttaggtgcttttatgggattagtaactgaacatcccatttggacagcaatggttgcagctaaaaagccagtagagtttcttgggatgccagtacagctaattaaatattcttctactttaatcactgcaattatttcagtttggatcatgtcctatatttataagtatgtaaagaaatatacaccaaatatggtgaaaatttttatggttccaatgttaacaatgcttataactgcacctttaattttcctagttattgggccaatctctaatatgatctctgaaggtattggatttatatctatgtggctattccacaatgcaggaattgttgctattccaattttggctgcagcatatccttggtttgtatctattgggattcacaaagctttaagcccaattagtattcaattagttgctacacaaggttttgatccaattattcgtgtagttgcattatgttcaaatatgtcacaagcagctgcttcactagcagttggtttaaagagtaaaaacaagaaactaaagagtttagcactttcatctagtgcaactgcatacttaggtggaattactgaacctgctctgtttggtgttaatttaccattaaagaaacctatgtatggagcaatgattggtggtgcaattgcaggtgtagttgcaagttttatgaaaattaaggcatttatttatgtcacacctgcctttttaagcttgccaatgtgggtttctaaaactgaaaattttgttattcaagctattattgtaattattgttgctagtgttgctacatttattgctacgtggatgattgggtttgatgatccagtagatgaaaataatcaaaaaactaagtttgatcaagtacatgaaaaacatgatttaaagagtcctgtaaatggaaaggtagagcctcttagtgaggtaaaggatgaaacatttgcaagtggagtaatgggaaaaggaattgctgttattcctagtgaaggtaaaatttacgctcctgatgatggggtggttacagctacttttgatacaggacatgctattggtcttcatttagataatgatgcagatgtattgattcatatagggattgatacagttcagatgaatggtgatggatttaaacaattagttaaaaaaggggatcatgtgaaagctggtcaagaattggttgattttgacatagataagataaaaaaagctggatatgatccaacagtaatgatgattgtgttaaacagcaaagatttcttagaagtattgccagttgtaaccaaaaaagatgaggaaaaggatgttacaacgaatagtaatgttattgtattagcttaggagataattatgaaatactatcacgtgcctgaaggatttaagtggggtgtcgcaacggctgctaatcagatagaaggagcttggaatgaagatggtaaaggaatttcaattgctgattgcgaacgctatgatcctgaaaaagcgagagcaggctataagtcagcaaatagtatgacaagttctgaaattaaacgtgctatggcagataaagatagtaaacgttggggaaaaaggcatggagtagatttttatcatcaatatcctgaggatataaaaaaattagcggctacgggaattaatacttttagaacttctattgcatggagtagaatttttccaaatggtgatgatattaagcctaatgaaaagggactagaattttatgataagttatttgatgagctacatagatataatattgaaccaatagttactctatctcattatgagatgcccttaaatttagtattaaactacgatgcttggtatgatttgcgcgttagagagttttttataaagtttgcaaaaattgtgatagatcgttttcacggcaaagttaaatattggattccgattaatgaaatagatagtattttgcgtcatccattttcttcagctggattaataagagatcgctttctaaatgaaaattttgaaaaggtcatctatcaagcaatgcacaatcagtttgtagcagctgctgcaataacaaaatacattcatgaaacttattctgatatacaggtaggttcaatgattacaagtacaatgatctatccttataatagtgatccacgcaacagccttaagagcgttcagttaatgcgagaaagctataattttagtgatattcaaattcgtggtaaatatcctctaaatttagtgccaaaattaaagaatttacatattaaaatatcaaaggaagacttagacttaattagtgaaaatacagcagattttattgcattttcatattactcttctgtttgcactgcttttgatacaaaaggattaaaagtaacaaaagcaaatcgtatggaaggggtttataacaaatatttacctaccagcgattggggatggcaaattgatcctattggtctaaggattatattaattaatttatacgatagatatcaaaagcccctatttattgttgaaaatggattaggtgctaaggatagtctgactacaagtggaaaaattcacgatgattatagaattgattatttacgacaacatattaaacagatgttagtctctatacaaaacgatggaatagagcttatgggctattgtatgtggggaatgactgatatggtatcagcatcgacaacacaaatttctaagcgatacggtttaatatatgttgatttagatgattttggagatggaacttataaacgatacttgaaagattcatatttttggtatcagaaacttttatcttttaaaaataaaattcccaaagattttttagacaaataaaaaagaattcaggtgcctgtagcaggtacttgaattcttttcatttagtaatgcttcaattctacaaattaggatcaatcttaaaccgaagtggtgaatctgcggtctgagcagtaatcaatttggcatttaatttttgatagttcttaatagcaacatcagttagttttttattagcttcgtttatgagctctacttttttagcttcatctttttcttgagccaatttcttatcatattcagctcgcagtttattcaaagctagattcgttgctttttgcgtattaactaaactagttgcatatttattccaatttcgatctactaagacgctagccattttaaatacccagtaagctgaatttgttgaaaattcttctttaccgtatttgaacatagttggtactttagttccttgtgggtaaaaaggaatgtagacactttgtgcagcaattcccattgctagccaatgagtcatattttctcctcgaagttggaggaggtgggactcctgggtagtagctacggcaattggacgataggcaggttgaccttcgtttttagaattagttaggtcatactgtgtcccattaaagtgatcgcttaaaacgcgttgagcgtcttgaatagatacaggatgatcaggctttctaataaatggtaaatcaaaactttctggatcttgatttacggaaggtgttagaagcttttggccactccaaacacgtggagtattataagttaaatccgaatcatcatgtgtaccaaaaattaatctgaaattaaatggtttatttttttgccaaagattattttgataaacaaattcttgaattccaggagaagttataaaattgtctttatcattaaaatcaatgacttgaatggctagttgattagcaactactgcgtatgaatcgtcagggatgcgttgagcaacataatggtggcccgaaccaatttccatataccacgcttcatctctatctgcgaataaaatcccatccgcttctgccgcaccgtgcttttgaacgatcttacctaaacgttctacaccttctcgagcagatttaatatatggtaaaacaactgttaccattgcttcttctaagatacctttttcttcgtcaaaaggatccatagccattacacgatcattagcataggcactttcagtagcgctcattgcaacgtgatattcattgattccatcttcttcaaatactccatatttatctgtccattcaggagtagaagagtaagaaaaacgttcgttaggtaattccatctgaaacttattatcttttgacttaaaaattttatttttaattgtttgatgtgaattaaaagcaagatgcttaggccaagcagtcttagcatcttcatttcggccgataataacactaccatctacagtagcgtttttaccgattaaaatagatgtacaagatgaacgtccaacaggagaagtcataggtttcacactttctattgatataatataatctatattgtaacgtataaaacttaaaaataagtgagggcattaaaatggcagacttaccagaagataaaaaaattattcttacaactgattacaaagataataccattaatatggaattttctgataatttagttgataatcgtgaaaaaggatacattctttcagctgcatttttagcatttgctgcaaatgaagggctagataaacaacaagttattgaaatgattaattctcattatgaccaatttactggtgatgatgattcaagtttgtttaaaagattatagaaatttgcacaaaattctccaaattttcatatttttgttataatataatgacgaagaaaataacagacgttaggcatttatgttgttttttagatgatcacaatgtgttgatgttgatgaatatgaattaagtgaggtaattaaagtggctagaaaaaaagaaatagataagcaaagaatcctggatgctgcttataaattagcagttcgtggtggaattgaaagtttaactgcaagaaatattgctaaagcagttaactgctcaactcaaccaatttatcttgaatttgaaaacatgcaagatttacgtaatcaagttttagcaagaatttctgatgaattgaagtctaacactcttcaacagaactttacaggtgaacctttgatcgatttagatctttcatacttgtactttgctaaagaacatgttgatttgtttagagcaatgtttgtagactgtaaatttggaaatcaaatgattgttgatactttaatgggacttggacttgaaaaattcaagcaacaatttgacgcagaacaattttctgaagaaagactcaatcatattgtgatttctaactggattgctgctacaggtttagcaactcttctcattaacaagatggcaaactttacacaagctcaaatgattagtgttttaaaggcacaaattcatgaagcaatgttaaatgaccgtcttactaacgttgaagaaaatccactatttgctgctgatagtgacgcttctcttgaagaacgtctaggctagtttcataggttaattaagcaccacgttcaactgaaagtggtgcttttttgttaaaattaaattatggcttttaaaatagtgagattaaaaagtataatttaatagaaagataattaaaagaaaggtgacgtagaaatgaaactctttgccattgtaggtagcaacgccgatcattcttataatcgcgatctactaaattttattaaaaagcattttactgatagatatgatattgaattgggagaggttaaagatcttccaatgtttaaagaaggagttaaagaacctgctgcagtagctagctttgctaaaaaggtagctgatgcagatgcagtgttaatctctacgccagaacaacaacactcagttccttcatccttaaagagtgcactagaatggctttcatcagctgaacacccttttaaagataagccggtagttattgtgggtacttcagttttaccacaaggatcagctcgtggccaaagtcatttaaagctggtgctttcctctcctggttttggtgccaaagtctttaatggtgatgaatttatgatgggaacagctccagaacaatttgacgaaaacggaaacttaccagctggaactgttaagtttttagatcatttctttgatgaatttgatagtttttatgctgaagtaagtaagtaggaggaacgacccatgaaattactagcaattgttggtacgaatgcagatttttcatataatcgttttttagatcaatttatggctaagcggtataaagatcaggctgaaattgaagtatatgaaattgctgatttacctcgttttaaaaaagaggcacaaccagatagtaaagttgaagaattcaaaaataagatccgtgaagcagatggtgtgatttttgctactccagaatatgaccatggtattccttctgcattgaagagtgcaatggagtggacgggaagccatgctcaaggaaatgcagatgtaatgaagatgaaaccagcaatggttttaggtacatcttacggaattcagggagcttcaagagcgcaagaagaaatgcgtgaaattttgctttctcctgatcaaagtgcaaatgttttgccagggaatgaagttttaattggtcatgctgcagataagtttgacaagaatactggagacttattagaccaagagactattcatgctattgatttagcatttaataattttgttaaatttgttgaacaagctcaaaaataagttaaaaccttattttcctatagtacaaaagaaactaggtagaattttctatctagctttttttgtcattaaagtttattattttaatgaaagaaagcattttcacaaagcttagaaaagagagatttatatgctcggtttttcagtttacttagataaagatttgactgcagatgatcataattatttgcttggaatgaggaatgctggttttaaggaagtctttacttcattaaccggcttaaaagatgaagcagacatagtactaaaaagattagatcagttaactagctggtgtaaagatttagagttaaaggtcatggcagacgtttcacaagatgatttacattatttaggctatgatttagcggatgcagaagaaataaagaagcttaatgttactggattaaggattaacgatcaagtattaatgcgttttgtatcaaaattgtctaaaactatgtgggtatctttaaatgcaatttacttacaaccagaagatattactcatttaaaagaagaggcagctaactttgatcatattagagccctatttgatttttattcccagccagaaacagggatggatgaaaagtggtttgaagaaaaaaatcaatggcttcacaattgtaatttagaaacagcagcttttatatctggagatggggttaaaagaggaccattttttgctggagaaactactcttgagtcacaaagaggcgtatatccattagcagcagctctcaacttaaaagatttggcctgcaataacgtcattgttggcgatcgtctaactagtgagacgattaagtcttttgcgcgttatacgaaggatcatgcaattacgcttcatgtagatgaaaaaaatactttcctcaatgaaaatcaatggcataattatttgtatcttgctcaagatatcgttagactccgtagtgaaggcgagcttccagagtttgaagcgaaggatttacctttggatcgacctgtgggaacaattagtatcaatagcaatggtttaaatagtaacgaaattcatattgctaagagaaatttacctgttaataaagatggaagggttcttggaagagtctgcgatgaagagtgtagcttgcttcctcatatcgagccaggacaaaaagttatttttaaaaatttagaaaagtagggattacaaaatgattaggccaaacattttaccactgcaacatgtgccaaatgcacgtgatttgggcggttatgtaggttttgatggtcgaaaaattaagatgcatcgacttctaagaacagggaagttatgccaaatgactaaagaagatgaaacttttttaattaattatggcttaactaaaattgttgatttacgctcacctaaagaaattgaattagctcctgatgttgtgccagcaggagttgaacatattgataatccaattcatggaaatcaaagtgcagaaacagatcaaaagatattgcaattaaaaaagacctatactaaagatcaatatgctggttttaagacgatgtgtcaccagtaccattcttctgttagtaaggaatattctcaaaaagcctttaatagtttacttaacatctttgctaatactaaagatggagctattatttttcattgctctgaaggaaaagatcgtacaggattagctacagttctgatcctatatattttgggcgttgatatggaaactatcagacaagattatctattttctaacttaatgctaggaaattatcaggctaagatgaatcaaaagataattgatgagggtggtagtgtgattttgcgtgctaacgttagaagcttagccagtgtcgcaaatgaatatttggatacagctctcttattaattgatgaaaagtatgatggaatagataattacattaaaaatgttcttaaagttgatgatgagatgattcaaagtttgagagaattatacttagaaccaaagaaggcatcaaaatgatagaaaattatgcttcaactccaatttcaaaagttgggcgcggattaggaactgttattacgctgcaggtttatggtgaccagaataaaaagattttggatcagagttttgatttgattgccggatatgaagatcgattaacggtaaatcgagaccattctgaggtaatggacgttaatcatgcagctggtattcatcccgtacaagtttctgcaagtacatataatctaattaagctagctgtttatgaaagtaaacaaaatttcggctttaatgctctgattggaccagttgtaaaattatggcatattggttttaaaggagcccatgttccatctgatgaacaaatcaaagagaagatgagtctaacgaatccagcagatgttagattagatgatgataatcagactgtttttttaactaaaaaagggatggagctggatctaggcggaattgctaaaggatatatagcagatagaattagagatttatggcgtgcttatgatgttcgtgctggaattattaatctaggtgggaatgtcttatttgtaaacagttctcctaaaagagcaagtggggaatggattctgggcgtgcaagatccgaaaaagaaacgtggtaataatttaacaaccgccactgtccatgaatgttctgctgtaacgagtgggacgtacgaacgctttttagaaattaatgggaaaaaatatcaccatattattgatcctaaaactggatatcccgttaagactcatgtggctggtgtaaccttatttactcgtgattctgttcaagctgaaattgagtgtaagcgactattttttgctggtggtcctattccaggctggaaaaatgataaagcaggtcgctatggtgcaatctttgtatatgacgatgattcaatggaaagaattggtgtataaaaaataggattcggaattaccgaatcctatttttgctgagtattttaaccaactgttcgactaataccaaatattgtcttaaatactccatttgacaaacctggtgtgttataaataattactcgtaaaattggtgaatcaactgtttgttgaataaaccaaggattttgaaaagcctggcacattgataaggctacataaactaagaagtaagcagcaataaaagatactattgctcctaaaacattgtctaatagattaccgattccctttttagtacgatcacgtttaggaagccagcccttacaaatctttaaaatcattttaccgataaaccaaattacaaagaaggctaagaaacggtaaccgattatttcaagactaatattgcccgttgtgggaacaaccttaccagaaaattgttgatagaaccaatttcccaagctgttttggcctagaatagctgctgcaaatacaattgcaccaaaaatcatattaataacacgttgagcaaatcccagttgatatcctttataagtttgataaccgagataaagaatcacaataagcgtaacaatcatgaatttaactccttttgctaatcattatagcttatcgattttaatttaaatacatatttttaaatacttagttgttttttgacgattcttaaaaaatactacataattaaatacgttagtttatgatgataatagtgttgttaaccgcctttaattgcggtaaattaggagtgtgaaactaggtttcacaggtgaaaaatgaatccagaaatttttgcaaaagagctcgcaaaatatggctttgaacttaatgagaagcaaaaaaaacaatttgcgacgtattatgataaattagttgaatttaataaaaaggttaatcttaccagaattactgataaaaatgaggtttacttaaagcacttctttgatagcattactccacttttagaatttccagacctatttaaaggtgagaaaactttatgtgatgttggagcaggagcaggttttccttctttaccaattaagattttgtgtcctaacttaagtatcactattgttgattctttgggtaaaagattaaagtttttagatgaacttgtaaacgacttaggtttagataaagttactttagttcatagtcgtgcggaagatgccggtcaaaataaagatttacgcgaaaaatttgatttggtaactggacgtgcagtggcaagaatgagtgttttaagtgaatattgtttaccactagcaaaggttggtggttacttagttgctctaaaaggaccaaaggcacaagatgaattagcggaagctaagcatgcgattgatgtattgggaggaaaagtagaagatgtgaaagaattaacccttcctgatacagatgatgaccgcactttaattgttgttgaaaaaataaaagcgacccctaagaaatatccgcgtcaagctggtacaccgaataaaaaaccactttaaatttaattggaggaataatttatggcattttcattatttggcaatcgtcaaaaaaagatccctgaaagtaagcaagttcaagaaattgagctcgataaaattatgcctaatcgctatcagccccgtcatacttttagtgatgaatcaattgaagaattagctactacactaaaagaacaaggcttacttcaaccaattattttgcgtaagccagctgatggtcccgaaggagaatatgaaattattgcgggtgaacgtcgttttcgtgctgctcaatcacttaaatgggcaaaaattccagcaattgttgaagatatggatgatgaaaaagcagcctctttagccttagttgaaaatttgcaacgtgaaaatcttaaccctattgatgaagcacaagcttacgttcaattgatgaaggttaataatttaactcaaactgaattggcagaacaaatggggaagactcaatcttacattgctaataagattagactactcaagttaacgccaaaagtgcaagggttcttaattgataaaaagatttctcaacgtcatggacgtgcacttttagctttgaatgaagaagatcaagatactgctgttagcgagattattaaaagtggcttaactgtaaaagaaactgaagagatggtaaaagatcttgatggttattttgctgctcaagaaaaggaaaaagaagaagcgctcgaagagaataagccggaacaaactaaaaagcctaagaaaaaagttcaggttcggacagctaatgatttcaaagtacaaataaatacgattaaaaaagcaattaagatggcaaaagattcaggaatgaccgtgaaatacaaggaagataaaaagggtgattcctacaaaattactattgaattgcttaaaaagtaggcaaagggagtaaatatggttcaaattatttcggttgctaaccaaaaaggtggcgttggtaaaacaacgacgacgattaatttaggtgccagcattgcaaatcatggttataaagttttaatagttgatattgacccccaaggtaatgcaacttctggtttaggtattgaaaagtcaactgtagataaagatatctataatgttttaattgatgaaattcctttatctgaaaccattcatcatacagaaactaaaaatttagatgcagttcctgctactattcaattagctggtgctgaaatggaattaacatcaatgatggcacgtgaaacgagattgaagcagggaatcgatgaggttagccatgaatatgactttattttgatcgattgtcctccatctttaggtcagctttcaattaatgcttttactgcttcagattcgattttaatcccagttcaaagtgaatattatgcaatggaaggcttaagccagttattgaatacaattcgcttagtccaaaagcactttaataagaatttgggtgtggaaggtgtattgctaaccatgctggatgctagaactaatctaggagcagaagttgttaaagaagttcaatcttactttaataaaaaggtttataagacaattattccgcgaattaccaagttagctgaggctccaagttatggtaaaccaattacagaatacgctccaaaatctcgcggttcccaagtatatgattctctagcaaaagaggtgttgaaagctcatggtaaaaaactctaaagaacctaaaaaacgtggtcttggacgaggcttagaagctttatttgatgagagcccacaagttcaagaaactgaggagattactgaaatctctttagacgaaattagacctaatccatatcaaccaagaaaaacgtttgataacaaaagcttaaaggaactttccgaatccattaaagaaaatggtgtttttcaaccaattattattcgtaaatcagttaatggttacgaaattattgccggtgaacgtcgttttcgtgcttctaagttagctaagaagaaaacaattccagccatcattcgagactttgatgaggcacaaatgatggaagttgcagttttagaaaacttgcaacgtgaagacttaacaccattagaagaagcgcaagcttatgagatgctgcaaaagaatttagggttaactcaagcagaagtttctaaaagattaggaaaatctcgcccatacattgctaattatcttcgtctccttactttgcctcaaaaaactaaacgtctccttcaaagaggagagctatcaatggggcaagcaagaacattacttggtttgaaggataaggatagtattgatgacttggccagaaaggtagttaagaacggaattacagttcgtcaattagagtcattagtagctaaattaaacgaaaaagaaaagaaacccaagaaaaaggctattaaaaaatcagctttcattagggctagtgaatcacaattaactgataaatttggtactagtgtaaatattaccgaaggtaaaaaaggaaatggtcatttggccattgattttgcatcaactgatgaattaaatcgaattttagatttactaggaattaatttagataaataattaataggagtgatttttcatgtatcatttgggcgatgtagtacagatgaaaaaaccacatgcatgtggtgaaaataagtgggaaatcttgcgaatgggtgcagacattcgcattaagtgcttagggtgtggtcatttaattatgatgccccgagcagaattcaataaaaaattaaaaaaagtgctgcactcagcaaatgatcctgttaacttaaaagaggaacattacgttcctaaggaaaatattgctgtgccacactttgaataaaaccaattaagaggagaataatatgtcattaactgcaggtattgttggattaccaaatgttggtaagtctactttgtttaacgcgattactaaagctggtgccgaaatggcaaactatccatttgccacaatcgagccaaatgtggggatggttgaagttccagatagtcgtctagctcgtattcaagaattaattccagctaagaagattgttcatactacatttgaatttactgatattgctggtttggtaaaaggcgcatcaaaaggtgaaggacttggaaataaattccttgaaaatatccgtcaaactgatgcaattgttcacgtagtaagagcttttgatgatgacaacattacttcagttactggtaaggttgatccagaagaagatatcaacacaattaatcttgaattagcaattgcggacttagatgcagttaaccgtagaattggaaaagtgcaaaaggttgctcaacaaggcgataaagaagctaaagctgaattagctgttttaaataaattaaagccagttcttgaagaaggtaaagctgctcgctcaattgactttaatgaagatgaacaaaagatcgttaagggactattcttacttacttctaaaccagttatttatgttgctaatattgctgaaagttcaatggctgatccagaaagcgataagtactaccaaattgtcaaaaagcatgctgaaagtgaaaatgcagaggctttaggaattagtgctgctactgaagaagaaattgcttcaatggatgaagatgaaagaaaagaatttcttgaaatggaaggcgttgaagaatctgggcttgatcgtttgattaaggctgcttaccacattttaggtctacgtactttctttactgctggtggtcctgaaacccgtgcatggactttccatgaaggcatgaaagcaccacaagttgccggtgttattcactcagactttgaacgtggatttattcgagcagaagttgtttcatttgatgatttaaatgagcttgaaaccatgcaaaaagttaaagaggctggaaagcttcgtcttgaaggaaaagactacgtagttcaagacggtgatattattgaatttagatttaatgtttaggagtttttttaatggatccaaaagatcaaaataaaagtgaaaatactgaagctgccaagaactcaacagtaggtaatgcgcaacaagaaaaattaaagaaggcgcatgaacaaaattctcgtgatgaagagattaaaaagatgtctccaaaagaattgcgtaataagttaagtaataaaaaccaagattacatttttcgtttggagaagtttttgacagaggatcaaaactatactatggatcaagttgagccagcaattgatcaaattttgccagaaattattgttgcgcaacgtaaaggaattccagcatctaacttatatcaaaaagctccaagagaaaaagcaattgaaattgctaatcctaaaaaagaagcacctaagactaagttttggatgcatgccgtagataatggtttattgtactttgttatctttgccggattctttggtgtagttcaactatttaacaacagttctaagcaacaagatggtatgcaacaaatgggtattttaactgttgcatcagttacaattttatttggtattttaatggcatactataatgatttaattactagggataaaagtaaacgtccaccaatgtggcaaattattttaataggtgtatttttagtcggaatcataatggtttggattacatttacatcaatgccatttatgcgggtgattaaccctgtattaaacccatgggtttacattgtattagcggtaattgctttctttgttcgcagatggttccgtcaaaagtaccatgttgttgatccattacaaattaagcgtcaaaatgaaattgccgctagaagacaaaatcgtcgaaattaaaaacgtgactatttatttaaattagtctacagtataaataaagataacaaataatttatttgttaagggagtgaatagacggcgcgaggcgtctatttatttttatcttttttaagtaaagaacgggggttttatatggttaatgtgttgcgtaagtcaattagacaatacaaaaaattgtcgttgacttccccagtcctagttgcaggtgaagctttaattgaaatgttgatcccgtacttggttggtattctaattgataggggaattatgaaaggaaatatgggctatatcaataagtggggcctaattcttttcgtactaaccttaatttctttagctttaggtgcaagtgccagttatgtttctgcacacgcagcagcagggtttgcggctaatttgagaaaggatatgttttatcatattcaagatttttcttttagcaatattgataagttttctagtgccagtttggtaacacgacttactacagatgtaaccaatattcaaaatgcctatcaaatgttaattagaattgctgttcgggcaccattaatgctgattttttcaattatcatgtcgattattatcagtccaaggctatctttgatttttgtggtaatcgctcctatctttgttttaattttggcattaattattaaaagtgcatatccttacttcccacgtatttttagaggatatgatgtaatgaaccaagatgttcgtgaaaatattcgtggaattcgtgaagtaaagacttacgtacaagaagaatctcaaattgaaaagtttgagaagtcttctggctttatttataaattattctcaacagcgcagaaaattatgtcgcttaatgcgttggttgtaatggctgttcttaacatttctactttagcgatttgctggtttggtgctaaggaaatcgttggtggaagtttgcaaactggacaattagtttctatgttttcatattcaaactctgttttgtttagtttgaatattctagctatgatcactactcaattagttatttctgaagctagtggtaaacgtattgcagcggtcttaaccgaaaagccagcaatcgaaaatccacgaaaacctcttaaggacgtaactaatggagatattgtttttgatcatgttaacttcaaatactcaccagatgagaaacattatgctttagaggatattaacctacacattacccctggtgaaacaattggtattattggtgagactggatcatctaaatcgactttagtttcaatgattcctcggctttatgatgtaacatctggtgctgttagagtagcaggacataatgttaaatcatacgaattgaaggcccttcgtgataaagttgcaatggttttacaaaagaatgttttgtttagtggaactgttgaagaaaacctgaaatggggaaatgaaaatgcaacacatgaagaagttgtagctgcagctaaggttgctcatgcagatggctttatccgcgaaatgccagatggctataatacaatgattgaacaaggcggaaataatgtttctggtggacaaaaacaacgtttgactattgctcgtgcacttttgaagaatccagaaattttaattcttgatgattcaacttctgctgtggatacgacaactgagcgtgaaattcgtgaatccttagcaaaagacatgccacatactagtaagattattatttctcaaagagttgtttccattaaggatgcagatcgaattattgttatggatcacggtaagattcaatcaattggaacccacgaagaattaatgaaaaccaatgaactttatcgttcaattgctaagttccaagaagaaaataatgcgggaaagtaggtgagagtaagttatggatcaagtaaaagaaaaaacacaacctaaaggaaaccgaataaaagtccttggtcgtttattaaaattagttttgacaacgagcccttggatgttggttgtttcaataattactattattttagcagctgcttctgctgtaattggatcactatttattgagcgactgattgatacttacgtaacaccactcttacatgaaaaagttccgaattatggaccacttttaaacgccattttagtaatgtttggaatctatgcaattggattcctttctaactacttatttagtatgttgatgggggtattagcccaaaaagtccagttccgggttcgtaatgaaacatttacccatatggaatctttaccaattgcttattttgaccaaaataactatggggatatcatgagtcggtatactaacgatatcgataccttgatgcagatgatttcccaatcattacctcaattcttaaactcggcactaagcttgatttttgttattgtagctatgtttagtttaagctggcaattgactttgttctcatttattatttttgctttatcctttggaattgttagatttttaacagttagatctagtcattacttcaaagttcaacaaaataaactaggtcaaattaatggttatgacgaagaaatgcttaatggcttaaaggtcattaaagttttctctcacgaacctgaagctgaagaaggctttgataagtttaatgaagaattgcgtggagcttctggaaaagctaatacctatgctacaattttattcccaatcatgggtaatatggggaacttattgtatgtcttaattgcctttattggaggagctgctgcaattaatggttgggctcctttaactttaggtgcaattgcatctttcttacagttatcacgtcagtttagtatgccgattgcacaaatttcccaacaattgaattcaattgttttggctttagcaggtgctcaaagaatttttgaactagaagatgagccttctgaagttgataatggcgatgttatcatgtctcctaataaggaagtcaagaatagctggtattgggatgttccagaaaagaatggtgatattaaaaaagtaccaattaagggacatattgtttttgaccacgttaacttttcatatgttccagaacatcaaattttgtacgatattaatattaatgcaaaaccaggaatgaaagttgcgttagttggtgaaactggtgccggtaagacgactatttcaaatatgcttaatcgtttctatgagattcaatctggaaagataacctatgatggtgttccaatttctcaaattagaaaaaatgatttaaggcattctttgtcgattgttttacaagaaactcacctctttactgggactattatggataatattcgttttggtaaacctgatgctagtgatgatgaagtatatcaagctgcgcgtttagcacatgcagatgagtttattcatgaacttgatgacggatatgaaactgtaattgatggtgatggcggcgatttgtctcaaggtcaaatgcaactgctcagtattgctagagcgatgattgcggatgaaccggtaatgattctagatgaagcaacttcaagtattgatactagaactgaacgtatggttcaagccggtatggacaacttacttgctggtagaactagttttgttattgctcaccggttatcaacaattgttaactcagatctcattttggttttagaccatggtcatattattgaacgtggtactcatgaagagcttttaaaacaaaaaggctactactacgagttgtacactggtaaaaaagaattagattagttaaaaatggagcctagatacttttctcggatccattttttataattctttaaaaacgtggtttaatttaggtaattagaaagaaaacaggtagaatgttaataatagattttttatgtgataaataattatagacaaggagcaatcctcatgaagatcttagttgttgatgatgataaagaaatcgttgaattattaagtatatatttaaaaaatgaaggttatgaaccgattgctgcatatagcggtaaagaagccttaacaaagctttctactaatccagaaattgcattaatgatccttgatattatgatgccgcaaatgtcgggtattgaagttatcaaggaagttagaaaagattcggagattccaattttagttgtttctgctaaaactagtgatatggacaaaattcaaggtttgattactggagcagatgactatgtagttaagccatttaatccattagaggtaatggcacgtgtacggtcacttcttcgtcgtagccagaaagaagtaaaagatgataagccagatgtattagaagtaggacctttagtgattaataaagattcacatgaagttaaaactttaactggtaaggttatccaattaactgccttagagtttggaattttatatatgcttgctagtcatcctaatagagtttttagtgctgatgaaatcttcgaaagagtgtggcaacaagaatcagttgtttctgcaaaaactgttatggtacatgtttctcacttacgtgataagattcaaaaggcaactgatggtgaagaagttattcaaacagtctggggagtaggctataaagtagaggcttagtagggatgaaaaagcagaaagtaatcctaaccacaaaagaaaaaagcgaacttttcggtgaaggcgtaataaccgttattttgcttttactcttgaacctttcgatcattatcttgattaacctagctgtcttaaatgatcctagattagaaaatggaattttctttttgaagaaaaccattacttttgctaatgggatgcatttatggtcttggcaacggctttttattagctttatgttagtcggcgatgccattgtagtgtactggcgcttaatcagaagatatcgacaaatgcaattacgtcacgttattgatgaattacactatattgcagatggtcattttgatcatcgaattccctttgttgtaaagacagatttgcaaaaagtgattgattcaattaatgcgttagttgatagtactgttgcttcaatggaagaggaacggcagatagagcaatcaaaggatgacttaattactaatgtttctcatgatattagaacaccactaacttcgattattggctatcttggcttattaaagagcagtgagctaaatgaggatcaaactaagtacattcaaatagcttatgataaagctcttcaaatgaaggccctagctgaagatctatttgaatatactactctgcgctcttcgacaaataataaattagttttaacaccgctgcatgttaattcgatgcttgagcaagtagctgctggttttgaattagaagctgaaaagaaaaacattacttttaatgtgataaccaggccaagagacctcgtaattgatgcagatgcaaagatgattgtgcgaatgttaaataatttgatttcaaatgctctaaagtatggacatggagcaactgaaatcaacttaattgcaaataaggtaaataacgaatttgtagaacttagagttgaaaataatggggaacaaatccctaagaaatctttgcaaaagattttcgatcgtttttatcgtgtcgaaagttcaagaaatttaaaaactggtggaacaggactggggttagcgataaccaaaagtattgttgatttgcatggtggtaatattaaatgtcaatcaacggcagaattaaccagttttattattcaactaccactccatagcccaaagaaaaaagatggtgtgctataatttaggctgaattgatttaaaaattggagagaaaaaatgagcgattctagcatttctttaaacacttgcatcttaatattgaaggaacaccacttgcttaaatcaagcgctgttcaagatgcggttccaactaaaatggattatatttcctatgattcacgtgatataaaaacaaatactttgtttttctgtaaaggtaaaggctttagacctacttatttatcaatggctaaagatagtggagctacttgttatgtagcagaacaaccatatccagaaggtaaaggaatgcatgctttagttgttagagatgtaactaaagccatggctcttttatctgctgccttttacagattcccgcaagatgatttatatgtagtagcctttaccggtacaaagggtaagacaacatctgcatatttcttgaaggggatgcttgaccaaattaatggtggtcgaacagcactattttcatcagtagatgatattgtaggaccaaagcctgaagacaaatttaaggcgagtttaactacacccgaaagtttagacttgttcagagatatgagaacagctgttgataacggtatgactcatttagtaatggaagtttctagtcaggcttataagaaaaatcgtgtctttggtttaacttacgatctcggatttttcttaaatattactccagatcacattggaccaaatgaacaccctaactttgcagattatttgcactgtaagttgcaattaatggttaactcacgtaagtgtattatcaatgcaatgtctgatcactttgatgagatttatgcagctgcaactactactacgaatccagatagtatctatttatttgccagaaatgattttgaaaatcctaacttaaagcaaccaattgatttccgtttccaatcagttgaaactgatatgaaagaaactgaattcaaattattctgtgcatctgataaagctaagaaattaccaattgctggtgactacactcttcaaatgattggtgatttcaacgaaatgaatggtactgctgctattattggtgctggacttgccggcgaaaattatgaagaatgtgctaaaggtattcgtcacgttactattccaggaagaatggaagctttgccatcaaagaatcatggtactgtaattgttgattatgcacataataaggcttcaatgatggctttaatgagctttatgcagcgtgaatttaacaatccaaaaatcatcgtagttgttggagctcctggtgataaaggagtatcacgtcgaccaggatttagtgagagtttaactgcttatgcagataaagcctttttaacaactgatgatcctggttttgaagatccaatggatatcgcacaggaaattgatgcaggcattgatcatgaaaaagttgatgtcacaattgagttagatcgtgaaaaggcaattcatgatgcaattgcaatgtccgataaggatgacatcgttttgatttgtggtaagggagccgacccataccaaaagattcgcggagtagatacaccatatccaactgacatcaaagttgcggaaagtgtaattaatgaactagaaaaagatgatgaggaataggaatgaagcactttttctcaattatcggtggaatggggacaattgcgactgaaagttatgtccgtttgattaatcaccgagttaagattactaaggatcaggactatttaaattatattttagtaaatgatgctcaaattcctgatcgaactgcatacattatggatcatagtcaacctaattttttctatgatttaaaggatgatgttttaagtcaatcaaaacttaatcctgactttttcgtaatgccatgcaatactgctcattacttttatgatgacttggcagcattaacaggcgtaccatttttacatatgatgcgtattgctgttcataagtttgtggatgattttccaaaagaagagaaaattggtttaattgcaactgaaggttctatttatgatcatttatatgtggatgaattagaacgagttggtaaaaaagctgaactaggtgggcctgaaattcaaccaatggttaatgagctaatttatcgtgacattaaggaaaaaggtattgttgaccatgacttataccataaaattttaaaaacaatgcatgatgaatatggatgtaatgtaattttactgggatgtactgaattatctcttgcccaggaaaaagcaccagatcacccatataatgtcattgatccgcagtcaattatcgcagatgtttcaattgaacttgctttaaagattcgaaatggaatggatcctaaagaagctactgcaaaatatatgtataaataaagataaaaagcctctcagatttggacaactgagaggcttttttgatccaataaagtatatttaagaaaaaatattgatataattaaggctaactttaataaaatttatctagaaagaaaaaactatgttacaagtagagaacttaaataaaagctttggaagcaaacaagttttgtttgatattaacttcaaagcagacaatggaaagatattaggcttaattggtaaaaacggctcaggaaaaacaactctttttcatagcatcttaaagtttgtcaaatatcagggaaaaattactattgatggacattctttttcaagtcgggattataactctgtcggctatttacctgaagagcgtagcttaatgccaaaattaactgttttagagcaagtaagttttttggctagtttaaagggaatgaaaaaagatgaagtaaaacatgatttgcaagattggatgcaaaagttagaagttaaaggccaaattaccgataaaataaaaagtttatctaaaggtaatcaacaaaaaatccaattaattgcgactcttattcatcagccaaacttaattattttggatgagccttttagtgggctcgatccggtaaacgtcgaaataattaaagaggtaatcttacaagaaaagaaacgcggagctactattctattttctgatcatgatatgtctaatgttgagaaattgtgtgacgatgtagtaatgattaataatggacatattgtgttaaacggtgctgtaaatgatgttcgcaataattttggtttaactcgattgtttattagaactgacctgaatcttgataatgttaaaaatttacctggggttgaaaatgctattttacagaataatggtatctacaaactttggttaacaaacgctagttacggaaaagaaatttttaatacgctctcccatggaaaatacttgcaaacttttgatcaagagccaccaactttagatgaaattttcaaaatgaaagccggtgaagagaatgaataaaacttggttagttgctaaagaaacatatcgtagagaagtaaaaaattggtcatttttattgatgattttcgcaccatttcttgtattattgatttcttttttctttgggatgagttcatcttcagctttcgacagtgatacaaaggtaggaatagtaagtcaaaatcagagtattgttcagccattaaagaaaacagaagattttgatggatataaaaataaggcaaaagctgaaaaggcctataaagatggtgatattagtggttatattgtggtgaaagagacttctactcaattagttgcgaactactatggtaccgaaagccttgataatgatgttaagactgagttgatcagagttttaaacactcagcagcaagcacttaatctaaaaaacgctaagctcagtgagcaacagatgcagtcactttctcaaaaagttaaatttactgagaaaactaatgataaaaaattgaatgcaagtgatgaaaagaatttaaagacagctactttttggattctaatttttgttttatactttttggttcagacttatagcaccatcatggcacaggatattgccagtgaaaagggaactaaaattatggaaatgatcttttcaagcatgcctggtggaaagtacttcgatggtaaagtgttgggtattttccttgaaattctaactcagttattaatttatgctgtgatgttttctggcttttattatatggctcctcatattgacggagtaaaagatacatttgctcaaataaagcctgctatcgatcaagctttaggacaaataatttcttggggattattattcgtcgtgcttggcttgatcctatatatcgtttatgcggctgtttgtggtgcaattgtcactaaagctgaagatgctaacaaggcagtacaacccttagtttatttaactctactcggattatttagtagtatgagcttatctaataatcctgatggtatttttgccatgattatgtcttacataccatttttatcatctttcttaatgccccttcgactaattaaaggaaacgcgactggcttagaggcagcaatctctctaataattctattagtatttttgctaggatcgatttggtggattagaaaaatttatccaagtcttattttgcaaactgatgataacggtatgtggaagaatatgaagcgtgcattacaaggcattaaggaataaaaatttaactactcagctttcaaaagttgagtagttttttgtgataaaattgaaagcgaatacaaataatgtagaggcttaattatgaatacaaatagtttagaaacatatgcaattaataaaaacaaaataaagataaattttgttaattctagtcttgaattaacaatcttaacacctgagataatccgtgtatttcaaaatcgcggtgagcatactaattcatatgcaattgaaggaaataagataaaagagactaaatttaaagttgagaaaaagaatgactatcttgaaataaaaactttaaaattaatcattaaagtttatcacgacgaaaaaatagatgtttatgatgcagaagaaaatcccttaattattgactatcggggctctagagttccaattgaccgacaaatagattcgagccagcaaaagttggcagagtcggaagggcatgaagtggctactagtagaagaaaagatggccactactatgaactagtcaaagaattagcagaagatgagcaattttatggcttaggtgataagaccggttttttaaataagcgtcactatgcgtatgaaaactggaatacagataatcccgagccgcaggtggaaagctttactcgtttatataagtctgttccatttctaattgggttgaagaacaatcatccatacggaatttttttcgataatacttatcatagttattttgatttaggcaaagaaagcaataaatactactatattgcagctgataatggaaatattgattattacattattggtggtagtaacttaaagaaaattgttgaaaattatacttacttaactggaaaaacaccgctaccacaaaagtggacattaggttatcaacaatcccggtggggatatagtataagcgctgaaaaggtagaaaaaattgttactaaaatgcgcaaatatcatctgccatgcgatgctatccatttagatattgattatatggatggctatcgagtttttacgtggaggacagatacctatgatgatccgaaaaaatttattgataaacttcataaattaggtttccatgtgattacaattattgatcctggtgtcaaaaaagatgatagttatcagatctaccaagaaggaattaaaaaaggatattttgtaaaagcaccgaatgggcaagtttatgttaataaagtttggcccggggatgctgtttacccagattttggtcgtgaagcagtcagaaaatggtggtcagaaaattgtaagtttttagttgatgtaggtgttgatggaatctgggacgatatgaatgagccggcctcatttaatggagaaattccaaaagatattatttttaatgatgaagaaaaggaatcaacacatgctaaaatgcataatgtttatggtcacaatatggctaaagcaacctattatggcttaaagaatttaactggtaaacgcccatttgtgattacccgtgctgcttatgcgggaacacaaaaatactccacagtttggactggtgataatcaaagtttatgggtccatttacaaatgatgattccgcaactatgtaatttaggaatgagcggttttgcttttgctgggacagatatcggaggatttggtgcagatactacaccagaactattaacaagatggattgaagcagcactttttagtcctcttcttcgaaatcatgcggctatgggtacacgctcgcaagagccatggatctttggagaaccaacgctatcgatatatcgcaagtacttacatttgcgctatcattttattccatatctttatgatttatttgctcaagaaaataagactgggcttccgattatgcgacctttggttttaaactatccaactgatccagcagttaaaaatatgaatgacgaatatatggttggtacaaatattgtggtagcgccaattgttgaagaaggtaaaaagtggcgagctgtttacttaccagaaggggaatggattgatttttggaataatgttacttatagcggtaataatacgatcttagttagtgccccgattgataggttacccttatttattaagaaaaatactattttgccgtggggagaagttaaggaacatatttccactagaccagatgaaaaaatgacatttagagtgtttggtgaacgtggtaaatatactcactatcaggataatggaaccgattttggttatcaaaagggtgagtacaatctttatgagataaatgtagatggtcataaagttactatcaatttgaaaaagcatggatatgagccaaattatcaaagaattgaaattaggactactaatgaaaaaatgaattttatttataaagatagaaaatatatacaggttaattaatttaatgaaaatgagctagtgcgatgttgtgctagctcattttttatatagaaaacttttcacttttaatagctttagttttgactaatattgaatgaatatgaatgattttgacgaaaaatgattgaatttatatctgaaagcgtttatcatattaaatgaggtgatgatgaacgatgctgaccgaggaacgtcaacaagctatagcaacctatattaataaacacagtatctgtcgtgttaatgaattgtgtaagttgactaagtcatcagagtcaacaattcgccgtgacctcattgaattagaaaagcgtggcgtgattgttcgtgtacacggaggagcacgctcactgcaagattattcacgtgatgttgaacaacaagtgagatttaatcttaatgttgacaataaacgtgagattgcacgttttgctgtgataaatcatgttactaatggagatcatatttttcttgatgctggaacgacaacttatgaaatggtgccatttttgcgagaagttaatgatttacatgtagttactaatggcgttgatgttgcactagcatgtttagacaatggaattcatactcgcttgttagggggcgaggctaagcttgaaacgcatgcagtcataggcaatacagctatgaagcagctacaagaaatgaattttacagtttcatttattggagctaatggtttaacagcagatggccaatttactacgccagatccagcagaagctgggataaaaaaagctgcaattgagcaggctaaagaatcgtttattttaatggatagtagtaagattggtgtagcaaattttgcaagttttgcacatatcaatgaggcaatactcatcactaacaatttaagtacaggtaaagaaaatatcttacctgaacaaatcagagttgaggaggctcggtcatgatttatactgttacagttaatccagcattagactatgttatgcaattagaaaaggtggaagctggtagtgttaaccgttcaaatgattgtcaatttttagctggtggtaaaggaattaatgtttctcaaattttgaaccaacttgatgttgataacactgcttggggatttgttggtggttttactggcaaagaattagttcgccaattaaacgttaaaaaaattgaaagtgattttgtaactatttctgacgatacccgtgttaatgtgaaaattcatgctcaaaaagaaactgaaattaatgcggctggtccaaagattgatgcacaagaaattactgcttttaaggcgcgtttggatgatcttaatgaaggcgatattgttgtattaagtggtagtttagcaccaagtttaccaactgacttctatgaacaattattaccaactatcagagaagctggtgctgaatttgcaattgatactactggggaagctttacttgcaactttgaagtaccacccattagttattaagcctaaccatcatgaattagcagctttatttgatacaagctttgctaatgatcaagaaatgcttgaagcagctaagaaacttttagacatgggtgcacaaaacgtcatgatttctatggctggcgacggtgcatacttagtaactaaggatcatatttaccatgcaagtgctgctgttggtactgctgttaactcagttggcgctggagattcaatgattgccggctttgtaggtacttactacaagactcataatgttgttgaagcattgaaagtcggatctgcttgtggtggtgctactgcatttactgaagatattgcagttaagagtcaaattgatgctgttttaccacaaattacagttgaagaagtaaagtagttaaaactaaataatacagttaggatagggagttattttcatgaaaattgaagatcttttaagtcctgatttaatgattatggatctgaaggctactactcaagaagaagctattaaagaaatggctgatcttgaagtaaagcaaggtgttgtaaataacgaagaggaattcattaaatcaatctgggctcgtgaaaaagaatcaacaactggtattggtgaaggaatcgccatgccacacgcaagaaacaagtacattaatcgtgccgctgttttatttgcaaaaagtcctaaaggaattgattataaagctcttgatggacaaccagttcatttattctttatgattactgcaccagccggtgctgataacacacacttacaagctttagctaagttatcaagtttactaattaatccagatgttgttaatgctttaaaggcagcaactacaccagaagaagttattgatatctttaaaaaagcagaagctgaaaaggatgctcaggacaaggccgatgccgaaaagagaaaggccgaagctgcaaaagaagcatctaagcctgctagcgagcaaaagcctttaattgttggtgttactgcatgtatcaatggtattgcacacacttacatggctcaagaagctttaattaaggctggtaaaaaattaggcgttgatgttcgtattgaaactaacggttctgaaggtgtaaaagataagcttactccagaagaaattaaacgagcaaaaggtgtcatcattgcctctgataaaaaagttgatatgccacgtttcaatggtaaagaacttgttatgaagcctgttgtagatggtattaaccatccaaaagaattgattgaagatatcttagaaaacaaggctccaatttaccatgctgatagtagtgcaagttctagcgataatgatgcaaaagaaaaacaagggttgtgggcatctatctacaagaacttaatgagtggtattagccacatgcttccattcgttatcggtggtggtatcttaatggccatctccttcatagtggaaaactatatggctggtggcgctaagaaccctgcatttattttcttaaatagtgctggtaacttagcctttgcatttatggttcctgtattagctgcttatattgctgaatcaatcggcgacttacctgccttgatgccagggtttgttggtggatacatggcagccattgttaacggtactaacggcttacaagttaacgcacaagcacatgctgtatctccagctggattcttaggtggtatcgctgcaggtttcattgctggatatatgatgattggattgaagaagttatttgctaaacttccaaaatcagtagaaggtatgaagccaatgttgctttacccaattttgggcttgctttttattgctttgattatgttctacatcatcaacccaatctttagttcagttaactttgctattacccacttcttgaacagtatgggtactggtaaccttgtaattttgacaatgatcttagctggtatgatggctatcgatatgggtggtcctttcaacaaggctgcttatgtctttgcttcaggtgcatttgctaacgatccacattctgcaactgctgcagttatgatggcagctgttatggttggtggtatggttcctccatttgctactgcaattggtactactttctttaagaaccgttacactaaggaagagcgtcgtgctggtgtatcaaactggattttaggtttctcattcattactgaaggtgctattccatttgctgcagctgacccaggtcgtgtaattccttcctgtgtaattggttcagcagttggtggtttacttgttggattgtggcacatccaagtaccagctcctcacggaggactatgggtatcaccattatctaaccatattttactttacttcgtagctacaattgttggttctattgtagccggtctaattatgagtttctggaagaaacctatctctgaagacccagatgaataaaaataactaattaaaaagtaagattctgaaaaattttagaatcttacttttttgtttaataaataacatatatttactatagtaatgtatagcattgaaaatgcaagatttttgaaatcgcattcttattgatatataaagaaaaataatatataaatagattacaagttcacacaaatatcataaattgtacacaattaaatcatagattatccgtatacttacttaatgtaaaaaacaaatataacaaggtgaaataaatgattattatcttaataatcattagcaagaaagctataacttaatgctcacctaatactagaagtatgaggataaaattatggtttccaagaacaattatagtgaaaaaatgcgaaaaattagaccgcaaaagcaacgcttctctattcgtaagtttactgtaggggctgcttctgtattaattggtttaacctttatgggggttaataatcaggaagctcaagctgacactacagttgctccagaggaaagcgtaaaagtcgaaagtagtacagctagtgacataacagagacgatggataacgtagtaaatactgaggaacagagtatatctactactgacaatcaaacagaagttatgtcggcagaagaaaataatgaagtagaaaatgatgtaactgcttctggtgagactggtaatgaagaagtaaaaaatgatcggtcgatttcttctgtagaaacagataatgtagacaaacaagcaactaacgaagtagtaacttataatgctgagtcaattaatggagacacagcagtaaaaaattaaaatactaatacaactgaaactaatttagttgaaaatactactcctgtagaagaagctcaagcagttgaagacgtagagaaaaatgctgcttctgtagatgtacagccagttgaaagcgtagaaagcaatacagtttccgtagaagaaacacaaccagctgagaaggtagaaaacaatactgtatctgtagaagcagatcagcctattgaagctgaaactaaggttgaaaatgaagcttctccaattgaagaatcagtggttaaagaaaatataactattcagtcgaatgctaaggaagttcaaagtaaagctgctgtaactattctgggaacagatgcggataattatccgaaaaaagcgggagatttaattggtgataataggtacatttatcaaattttaaacttgaatggtacaagttttgtgagtagtgataacaaaaagcttatcttgtctgtaaatcgaaataatctatccgatgacaatctttatgcatatgtaactgacaatagttttactgaaattttgtctacccatactattcaagcaggccattttaagaatattgaggtagtcaatgggtggcacactgtaaaatttttagtagttaacagtggtaaatctaatatttctattaatggaagtgaaacgcctgttggaaacgctagtacagttgtgggaagtacaagaattgaatattgtctaggcaatagtactagcatagatgcgagttcaattggtgaaattatcccagtttatactgaacagtctgtgattaaatactattacaatcaaaatggcaatttaatagaaattccaggcactgataaatatccaaacgttaacatatctggttggactgggcaaggatttattgttgacaacgttgatcaatacaaacagctaattaatggcttttacttagatgcttcaaaacttcctactggttcatttactggaacactttctcaatttggagatggtagttactataagaaagtatactacagtgctggagataaaaatgaaggtactattgatcagttaactgtagattttacagtagtttaccgtcaaattgacgctactggtaagatggaagttttgatgtatgatggcaaagacatgactaaggttattgaaagccatactgtagaagctggtaaatcagttaacttctctcataacaactacacagctagaaacccattcgtaactgactcagctcatgaagtacagtttgtttataaagaattaggttctttaattttagttgatgaaaacgggaaagaaattcatccatctgtaaaatttaacaatgataaagatgatccgactaaggctggtctaacctatacaccggttattgagggatatattgctgatattgaatttgtaactccagaagatccgggtaaagatatcaaggttgtatatcgtttacgtgaggatgctaaagctacaattaccattgttgatttagataatttagagaataatggtggtaaagttgcagaattaaatgcaactggaaaagtatattctgtaattaattttgttgacttaagtactacactccaagacttgattgatagaggatatgtagttattagcaatgattttaaaccaggaacaaaatttgatgtaaaagatttagaatttaagattgagttaaagcatggtcttgaagaaattaatgaatcacaatctgtagataaaattatcaactatgtagatggggttggtaataagctacatgattcagttacacaaacagccattttcaagacgaatggttatcgtgataaagtgactggaaagattgtagaagtaacagaagttgaacacgatgatggttacgtaattgctattgaaattaccaataaggacgctagtttacagtggacttctaagacggatgtctttgaatcgatcaaatctccagatattgttggttacactactacacaaaaatggagtactgcggataaagtagatcaggatgtaaagcatagagtagaaaatattgtttatgataaaaaagctcaagttggtacaattactttttgggatgaaacttctaacaagcaacttggatcaactatcaatattgcgggtaattaccgggaagtaattaactatcaaataattgaaaatgttttaaatagcatcaaagactatgaaaataataactatatactagtaagtaatcctttaacttatgccacaacatttggggatgcagagtacaatcctggctgtaatgattttagggttattttaaaacataaaatcgctgaaaatacacaaaataaagaagtaaaccgagtgattacttatgtttatgcagatggacctaataaagaccaagaagctgcaaattctgttgctcaaaaagttacatttattggaacgggccaatatgactctgttgataaagcttggattggtgatattgtttggacaactgaagccggcgatatgaactatacttttgctccagtagaatcaccaaaggttacagggtatggcgcagatagaggaattgtagaagctaagatagtaagtggaagctctgataatatcactgaagaagttctttattatgcaaatcaaacgggagctagcatccaatacattgatgacgtaactggactagttatcggtagggatgaagtacagggtaaagtggatcatcaaattaactggaaacaaaaccatgaaaatgtccttaacctgtttatagaaagtggatacaaacttgtaagtagtgactatgaatttggtaaagattactactattctgcagatgaagctaagaataactttacaattcatttaactagagatttgatcattattgatccaacgaatcccgatagcccagcttacggatcagaagattacattaaagaagtaattcaagagattcaatatgtttttgaaaatggcagtaccgcagctgaaagtaataagcaaaatatcaaatttacagcatacggtgttgtagataaaacaactggaaaatatgtagttcttgatgaaaatggcaagattgttgttgatgaaaataaacaaccaattgaagggacacttacttggaaagcagatataacagatccgaaatttgctgaagtaatatcacctactctagctggttatacagcagataaaacttgggtttctggaagttctgtaactgaaaatactccaaacaaggtaattgtggttacttatactgcaaatgcagctaatgcagaaattatctatgttgatgagactaccggtaagcaattagaaactgcagtagttgacggtaagtacaacgaaacaattaactacagtacagccgataagattaaatactacgaaagcttaggctatgaattagtcaaagatggttatgttggtggagaattcggtgaagacacaaagactttctatgtaacgttcaagcatggaatggtagttgtaaatccagaaactccaggcaagccagatgaaccaattaacccagacaatccagatggaccaaaatacccagctgattctgctaacttgaacaaggatgtaactaatactatccactatgtttatgcagatggaacaacagctaagccgagtcacacacaaactttaacttttgttggttcaggtgtgattgacaaggtaactggtcaatatgtagaagtcgatgaaaatggtaatgttaagcttgacgagaacggtaacccaattcccggcaaattaacttggacagctagtgatggaacaacgtttgtcgaagtagtttctccaacaattgttggctacactccagataaaggagtagttaatgcagttgaaggaattaaccaagatagtaagaacctagaaacaacagttatctacactgcaaatgcagctaaggcagaaattatctatgttgatgagactacaggcaagcaattagaaactgcagtagttgatggtaagtacaacgagacaattaactacagcacagcagataagattaaatactatgaaagtttaggctatgaattagtcaaagatggttatgttggtggagaatttggtgaagacacaaagactttctatgtaacattcaaacatggaacagttacagttactcctgatgataaatttaccgaagaggatccaattaacccagacaacccagatggaccaaaatatccatttgattcaattgctttagataaaacaattactcgtacaattaaatatgtttacgcagatgggactaaagcaaaagatgaggtagttcaaaagctaagattccgtggtacagccattattgataaagtaactggcgaagttattatcttagataaaaatggcagaaagatttctgatggaattaaatggacagcacttgatggaactacatttatacaagtcatttctccagatattgccggctacactccagataggaaagaaattggcagtcttgaaaatgtagataataatactgacgatatcattgaaactgtagtttacaataaggatatcgtagatccagaagaaccaaaggacccagtagatccagaagaaccaaaggatccggtggatccagaagaaccaaaggatccagaagaaccgaaggacccagtagatccagaagaaccgaaggatccagtggatccagaagaaccaaaggacccagaagatccagaggattcaaaagttccagttcaagctgaaactccaactgaatcaactaatgatgctcctattcttccagaccaactttccactgatactactcttaaggaagtagcaactgtagaaaccaaagaatctggtaaagtagaagcagctacaactgaggatgtttcattacctcaaactggtcataaacattctaatgcaggacttattggactaggattagcaaccattgcgtcacttttaggcttagcaggtactagaaaacgcaagaaagattaaattagttgaataaaatagttttgtgaaaaacgctacctccgggtggcgttttttagtatagtggagtgtggataataaaagtggaaagtgagactgaaaatgattaagcttattgcaactgatatggatggtacttggttaagagaagataagacttatgataaggaactctttgaaaaagaatttcaaattatgcaggatcgtgatattaaatttgttattgctagtggtaatcagtatgaaaatatcctcgatcgttttccaaaagctaataagaatatgtactttgtggctgaaaatggtgctttagtagctcatggaaatgaaattcttcaaatatctgatttatctgacgaagattatcaaaccatgcttgaaattgtggaaaaattaccatataaggctattgttgctggtgtaactagtgcatatgttgaaaaaagcagtggaaaagaatttgcggaagatctaaaaaagtacgttaagaaaattcaagttgttgatagctttaacgatatcgatgatcgtatttttaaagtaagtcttcgtgttccagaagataagatgcctaaggtcttagataaacttagagaagattatccacagattggttttgtctcaggtgcaagtactgctattgatatgcagactaaaggaatgaataaagccgtaggtttagaatatttaggtaaaaaactgaagattaaatctagtgaaatggtgacatttggtgatagtggtaatgatgttggtatgcttaagtttgcaggtacgagctttgctacggctaccgctcttccagatgcaaagaaagctgcgaatcaaatcattggatctagtgaagaatcaagtgtgcaaaagaaaattcttgagttactctcataattaaatgtaagttgagataggtgaacaagttgaacgatcaaattattcgagttactagagctttaaatcatcccattcgaattcaaattctttattacttaaatgacaatcaaaaaagtagtgtaaataacttggtaaaacagtttgatgttagtcagccagctatttctaggcacttaagaatcttagaagaggctaagctagttaagagtgagcaagttaagcaagagcggtactatagcttagaagataagcatgtaattaagattctagatgtcttgagacggcacgttaatgaagatttttagttcaaggacttgaataatcacagcattttgactgtcttttttctgaacatctttgacaaacatataaaaatatgtttatataaagatgtaattttagagaaaaagcattaaattaaaaattcagcaaattttttattatttatacttattgatagcatcaagtctgagacgtcttggtgctatttgtctatctagaaaaatgttgacataataaaaaatttagcttagtctaactttaagttagaacttatgctgaattttctaacttaatgcttttttgttttgcacaggaggatatatatgcaaaattttaaatctaaaattacaaaatttatttctattatgagcttagtgacgcttgtatcattgataacggtaggatgttcgaataagcaaaattctgccaaacaatcagataaaatttctatagttactacaactaatgtttattcagatattgctaaaaatattgttggaaaatatggaacagcgactgcaattattgataaaagtagcgttgatccacacgattttgatccgacaacagcagatgctaaaaaggtagctcaggcaaatattattgttgcaaatgggctaggttatgattcatggatgaataagttagcgaaatctgttgataaaaagcctgtcttagtcggtgaagacttgatgggattaaagagcggagataatccacatatttggtacaatttagatatgccaactaagtacgttgattatttggttaagcgtttatctaagttggataagaagcatgccgcttattttaaggaaaatggcgaaaaatacttagccaagatcgacaaaatcaaacagctagctcaggctaataagggtgatcaaaaaccagtttttgttagtgaaccagtctttgactatgctttgcaagaagctggttataaaataggcgacaagaaatttgaagaagccattgaaaatggtacagatcctagtcctaagacaattaacgaaatgaataatgctattaaacaaaagaagattgccttttttgttaataatactcaggcaagtagctcaacagttaagtcttttgttaaacttgcaaaaaagaacaatgttccagttttaaatgttcgggaaactattcctaataacactacttacttagcttggatgaaagaaaattatcaaaaactagctgatattcaaaataattaaataggattggtttattagaagaagaggaggagtgagatgactgatatattaacagttaaagacctggggatgaaatttgaggataaggtaatttttaaagacttgaattttaccctatcgaaggggtcgatgacagctctacttggtgcaaatggtacaggaaaaacaaccttgattagaattttgatgggaatgttacaaccaacgacaggatcgtttaaatttgcgccagatacaaaagtggggtacgtaccgcaatttagaaatttggatgctgattatcccctctcaatccgggcctttgtagaacttaatactcctttatttaagaacgctcgggtgaaggcgagagtaaatcaaattttaaaagagactcatttactagatattcaaaatactaggatgggtgaagcttccggaggtcaaaagcagcgtgcatatttagctcaagctttgttagataaaccagacttcattattttagacgaggcaacagctagcttagatccagttgctaaagaagagttaatgtcattgattaagcacttaaacgaaaaacacgcaatgactgttttgtttacaactcatgacattcctctagctaagaaatatatgaaagattatcttttatttaaggataaaggtttaattgctggtaaaattaaagacttaactgaagaggtgggtgaagaataatgtttgcatatgattttatgcgctatgcatttctagctagtacttttattgctattacctgtggaatagtgggtgtatatgttgtagctagaagtttttcattcttagctcacactctatcagaaattggttttgccggagccgcttttgcggtttggattggttgggttcctctctggggcatggttctttttactttgcttggctcaatcagtgttggtgaattatccatgagaagtgatcagaaagaatccgcaattagtgcgatttcagccttgtttattggcttgggtgtactatttttagctattgctggcggtaatagtcgctatgcgactaacatcttatttggttcaattattggagttgatagagatggagtcattcaactagttgttctttctctctttgttttagcaataattttcctagttttaagacagttaaactatgattcatttgatcatgtaggggcagttagccatcatattaatacaagcttagtttcagtagtatttttaattgctttggctttagctgtttcaattggtgcacaagttgtcggatcattattagtctttattttattaactttgccatcttcaagtgctcgctacttaggtaagacaattcctgctatgttatgttggtcagttgggatcgccttgtttggagtttgggcaggtttagttttaggatacgtaactaatttaccggtcactttctttatttcgattattgaagttggaatttatttatttgtttatggcgttcatgcttttaagaaataaaactgttatttagaacctacaagggctctcttgctcttgtaggttttttgtttttaaatttccttaatatgtggaaaaaggataaaattaaatagtattacttttttagatgaggaaaactatgtggataaattttttatgggcattagtgccaatcatctggttgataatttctcttggaattattggtatgccggcttcaagggcatgtacgattggtttaattattacaattgctgatgctgttttaatgtttaaacaacccataattaatactctttctggagccttagaaggtattataatgggaatttggccaatcatgtatgtaattttggctgcgctttttatatatcagattacaactgattcaggtagtatggggacgattgaaaaattattatcatcaatcacaaccgataaaagaattttagtattaataattgcttggggttttggtggctttctagaatctatcgctggttttgggactgctgtagcaatctgtgcaggaattttaatttctttaggtttagaaccgatccaagcttcagtaatttgtttggttgccaatagtacggcaactgcatttggtgcaattggcttgccagttttgacattagctgaagtaactaatcttaatgatgtgcaattaggatttattgtaaccttgcaattggtcattttagttattttagtaccttttattttagttattcttactggtaaaagtattaaggcccttaaaggtattgtctttattactttaatgtcaggggttggaatggcaattccgcaagttattattgctaagtttactggggctgagcttccagccttagtcggatcattgttttcaattttagttactgtctggttgactaagagaaaaactggttcagtagaggaagtagaaaatgaaagtgttagcgagattctcaaggcttgttcaccatttatcctggtctttattttcgttctactagcttcatctctttgtccacctgtgaataactttttaactagtgtaactactcacttacatgtttacttaggaaagaatcctaatgatctaccaattaattggctttcttctccaggaacattaattttattagcgggaataattggaggaaagattcaaggcttaagcttaagccaaatgttcaaaatcttgctcaatgttttgaaaacaattgggatgacaacaattacagtttgtgcaattgtgggtttagctaaagttatggtatatgcaggaatgactaaagcattagcggtagccttagtaagcttacttggaccagcttatcctttatttgcaccattaattggggctctaggaacattcttaacaggctctgcaacgtcagccaacgttctatttggtaacttacagtattctgctgctcaatcattaggagtaagcaaatattggattgttgcttcaaatatgactggtgcaactgctgggatgttatcaccacagaatattgcagtagctactggtgcaattaataaagaaggtttagaaggaaagattctaaaagaaacgactaagtggggtagtatttacttgttaattacctgtgtatttctatacttagttggtttgattactaaattagtataaagtaaaaagttcttgatctcagaagttagatcaagaactttttgtttacaaatatatttgtgtttttactagattgttttcaattcatcaacgattttttcaaactcattaaggcgttcttcaaaggtgttaaatgcgtcttttaagtaatcggcctttgtcatatcgacaccggcacgtttcattatctctgttggataatctgaagagccagcctttaagaaattaatataagcggtacgttctttgtcagtaccatgaacaacattatttgcgagagctgtagcagcagcaaagcctgttgcatattggtaaacataaaagttgtaatagaaatgaggaatacgggcccattctttagcaatctctccgcccggttctacactatcaccgtaatatctttggtttaaattgccgtaaaattcatcaagaacatcggcagttaatggttgaccatttgcgtcagcttcatgaataaactgctcaaattctgcaaattgtgtttgacggaagagtgtgcccttgaatgaatcaagatagtgattcaaaacaaatgcgcgtgttttaggatcagtaatcttatctaagaagtattcagttaaaatattttcattagttgttgatgcaatttcagcaacaaaaattgggtagtctccatatacatatggttgagtatttcttgtataccaggaatgcactgagtgtccagtttcatgaactagagtatatagagaatcaagattatcctcccaatttaataattcatatggatcagtatcataagaaccaccagaataagcgcctgttaccttattttggctttcaaccacatcaattacacgattattaaagatgtaatcaacatgttcgaggtaatcttttcctaatggcgctaaggctcgtctagcttcattttttgcttcttcaaagttataagaaagactgggctcacctgttaatggaacatacatatcatacatttgtaaatcagaaagacctaaaatcttttttcttaaactaacgtagcgatgaagtaagttgaggtgactatttacctctttaaccaatgtatcgtaaacagctgttggtacgccattttcacttaaagcagcctctcgagctgaattatatttatgtacttgagcattaaaattgtgggcttttacttcacctgataaagttgaagcgagactattttcaaactggccatagcttgcatacataacatcaaatgcatttttgcgaacatttctatcttgtgactgaattagaagtgaatataagccatcagataattggaccatctctccgtcttcatcttgaacatagccgtattccatatcagaattagttaaaacattgaaagtattagcggaagttcccattgcatctccagcagcggcaataattttttcttcacttgctggtaaagtatgaggacgtttcttagtaatttgttcaagtcgatgttgatactcttttaaacggggctcatcttgcataaatttagcaagtgtctcttctgggatagataaaatttcaggatcgacaaaagagatagcggcgctcatctggttagctaagctttgagctttagcaacaaggcctagataatgagtattactagtatcaacgtcgcttgacatagtagcataaacatatactttttctaaacgacgattcacagataaaatttctgtaatcccctcatataaatcttgaccagatttagcaagatttcccttaaatctacctaaatttttaatttcgattgcgacccgattatattcttgttcccattcctgatcgtctttaaaaacacgactaagatcccatttgagatcatcagatacttcatttcttgttggaatagccataccttgtccttctttctaccatataatttttattaatcatcattatagaacattatttcgcttgctaaaaaataaaatttttttaataatgaatttaatgcgcttaactaagtaattttgtattatgaaaaggtaagctgattttcagaggagttaaaaattaatgagacctgaggaacccaaaagaccacgccaaaaactaaaaagaaataatgtgtttgcggcgagtaaaaaagattataaaaatggaaataattttgctcgtttggtaggtctcttatcaattttacttgtttgtggaagcgtagcttactttgctcatgcatatttctcagctatgagttcagttcaacaagcttatcgaggaacaggaaaaacatcgcaattgatttctcagaaaaagccaatttcaattctaattcttggcgttgatcaaggaattgagggcaggcatgaccggggaaattccgatacgatgatcttagccactatgaatccagagaaaaaagaagcaacaatgacctcaattcctagagacttgttagctgatatcaaaggtgacggacgcggagaaggaaagtactacatgttccgggctaactctgcttatcaagttggcggaagcaaaggagcaactcggacagtaaaagcacttttaaatacaccagttaactactatatggaagttaatatgaaagctctagaaagtatggtagaagctttgggcggagtagatgttaatgtgccatttacctttacctatcacacgcattttaggaagggaaagcagcatttaaatgggaaagaggccttagactatgtgcggatgcgtaaagaagatccaaaaggtgattacggtcgacaaatgagacaaagacaggtgattaatgacattgtacgtaaagggatgtcagttaattcaatcactaactatcgcaagattcttaaggtctttgccaagtatgttaaaactaatctgacttttgatgatatgctttcaattgcaatgaattaccgcggatgtactcagaatattaagagtggctatattcaaggacataatgtttggattggagcggcagcaatgcaagtggcctctacaaaggaactacaacgcgtatcggatttagttcgttctagtttaggattaaaacaggaaaaactccataaccaagaaacaagacaaaatagtctgcagcaaggtttaaattggaatgatccagaagacttcagagattatgtgatttatgacaaagattctgatactattccatgggatggtaattaagtaaaaagcagctagcaaaatgctaactgctttttttagtatatctgttgatgattctatcttagtgattttagaccgtaactgcaactgttgtttgtaaagttttagttacctaattcagaatttgggttttcttgactaattcttttttcttcaaacttgatatcggctaatttattttccttttcttcttttatttgatcttctttgaactttttacttaggagagttggtttaatggtattttcaactaggcttttagacacattaaaattggtatcttgatcagctgcctgagaagtagtaactgaattagttaaaaagccaaagcctaataatacaataagcgctattgaaattccttttttgtgtgtcaaagtgtttactccttttaagtttaaatttaataataattaaatggtaatcatgttacactagtgatatttaaaaagtcgtttttaatttacttaacaaactgtattatagaagaggattattgcagtaaattaaagcgaaatttacatttttttacaaaaacttcaattacgtaaatttaatgtaatatttgaaagatcagtgtaataaaaaggatgatgaaaaaatgaagcaaactaagtattttccagttatttatggggtaatatcagcccttattgcatttattgcagtgttttttattgcacagagaaccttccatttttctgtatcaatggctattttaagtgctggaatttttgcggctttcttttatgttctgtcatattttagaggacatgcttcttatgaaattaaggcaattgtagctaaatatcatttaacagatgaagaacttgccaaaataactgggatgaaggctagtgattttccaatctatcacaataagcttcagttaattatccctaaaagacaatggccaaaagtcttaaatgcgcttcaagaatatgatcggcagcgtcaattatcaaatgaaaaagagaaaaaataatgagtttactaacagttaaaaatttaagtcagacatttattgataaaactttatatgaagacgcaaattttgtcttaaataaagaagaccatatgggggtaacagggcaaaacggagttggtaaatcaactttaattaagattttgaccggtgaaattactcaagataatggcgaggttaaatggcaaaataaaattcatgttgggtatttagatcagtatgccaaacttgaagaaggtatagagcttaaggaatttttgcagactgcctttagtgatctttttgataaagaaaaagaattaaatgaactctatgtgagatatggtgaaaatggggatgaagctctcttagaaaaggcaggtaagattcagactttacttgaggaaaaagaattttacgatattgataccaaaattgaccgcgtagcgacggggttaggattagcggatttgggttatagccgggatgtatcaaaactttctggtggacaaagatctaagttgattttggctaagcttcttttacaaaatccagacgtactggttttagatgagccgacaaactacttagatgttaatcatattgactggcttgcagactatttgaataactttgagggtgcttttatcgttgtttcacacgattatgattttttaggtagaatcaccaactgtattattgacattgattttggaactattacgcgctatacaggtgatttaaagcatgcacttcgtcaaaaggaagctgaccgagaaagctatttaaaggcttatgccaaccagcagagaaaaattcaaaagactgaggcatatattagaaaaaataaagctggttctagatctaaaagtgctaaatcgcgggaaaaacagctagcgaagatggaaattttaacgccaccacaaaataataaaaaggcgcatgtccttttcccttatgttgacactgcatcaaacttgctcttgcaaactcaagatttagtaattggatatgaacaggcattagtaaaatcagcatttaacttttctgttggaaatggggaaaaggtagctgtaacaggttttaatggaatcggaaaaactacactgctaaagactttactaggaaagttaaaaccaatttatggtaattttgaattatcttcaacagctaagcttgcttattttcaacaagatttagcttggcctaataaaaatatgacgcctttgcaatatttacaagaagaatttccacgtctgcgtcctagagaattacgacaagccttagcaagaatggggttaactgcacagcaggctatgagtcctttaaaagagctttctggtggagaacaagagaaggtcaagcttgctaagatgcagtttgagccatccaatttactattcttggatgagccaacaaatcacttagatattgctacaaaagattctttaagaaaggcaattgttgaatttaatggtggagtaattattgttagccacgagagagatttctttagaggaaattgggtggataaaacaattgatattgagaagatgaataatgaataatatttagaggattgaaatggaaaaagagcgtgtaagtcagaattatgctgctgaagttttagatacttgcttaaaagctggtagattaatgattgaaggcggcagtgaaacgtatcgagttgaagatacgatgatgagaatagcgcgtaatgccgggattactggtgcaagatgttttacgactccaactggaatttttatgagtttgggtgaacactcttatactcaggttacacaagttaaaaaaagaaatattaacttagaattagtagatcgagttaatgaattatcacgtgaattcgcggctaaagaaataacattaaaggaattacaagagcgtttaaaacaagtttccatttcaattccagactttccaatatggcttcaaattattggagcggctattttaagtcctactttaatggtcttgtttatggatgattatgactggattgattttccggccgctgctgtgatcggcggagtatcttatgctctttatttagctattaagcgctatactagtattcgcttcctagctgagatggtaactgcaatatttatgggagttattactattttgacgtgtaaaatcttccctaagcttgtagttgataatattttgattggttccttgatgactttagtgcccggtgtagcaatcactaatgcattacgtgatctgtttggtggcgacttattatcaggaatggctcggacaaccgaggctgttctaacagcaattgctttaggtggcggaattggtattgcaattaagttgttgtggggtgtgatgtaatgcctttttggttagaaataattattaatttagtatttgcatggcttgcagctgttggctttgggttaattattaacgtcccacaccgcgctttagttttatgtggcattagcggaagtgcaggttggattctatactggctggcaaatcgaatcggtgttggccgattggggtctaatcttttaggagccctgtgtgttggaattctagggctggtatttgctcgtattaaaaagtgtccagtaactgtttttaatattccgggtgtagttcctttagttccaggtgtaccggcctaccaggcggtgcgtgcgatggtagaaggtcaattatctgatgcagaagatctgatcctgcgtgtagcaattgtcacgatagcaatagcgatgggttttatgcttgcacagttaattggagaaatctttttcaagaagcgtcaaaatagaaaaaacaagaaaaatttggtataataggacatgcgacgagtcgaggaaaacgcgagatgcgttctttgacagagatcatctagacttgcgaagtcaaagcacgggaagtgctgatgatgggctactttggctgtgaaacaaagaccctgacatacttttgtatgtttctcgcaaaaaagactagctttcttttgaaagttagtcttttttagtactacaatatccttgaaagtaacttaatgaggtaaaaacttatgaaaatatctattcatcatattgtaactcaaaaggtcggtaattcagttggcttttcactacctgcttcttttaaagtagaggtaggaactgagtatgcaattcatcagaaagctgatggaagtttgattttaataccgaaaatttctaatccttatacctccgatgctaaatttgaagatgtaccaggaccagaaagggaagcttgggaaaatatggctatggaggaattacgtcatgccgaagaataaatttaaacagggagatattgtgtgggcggatttttcaccgtcagttggacaagaaatgaagggaaaacatcctgctgtagtagtgtcgtctaattcatataatgaaaagactaattatctaatggtttgtccaattacatcccacggtaatcatttccctacctacttagacttgttcggatatcatattcatggtcgtgtaaatgcagctcaaattcaaactttttctagaatgagattgctagatgaaaaaccagcagatcatcttagaccagaagatatgcttaaagtaatggaattacttagttttgctttgcaacttgattaaacgagtagttaatttttgtagttgcatgaaaaagatttattgagtatcttagtaatgaaaaaggatacacaaaggaatttttatcgtgaaaattaaacaagaagaaataactaaaaaaattgaagaacaagattatcttcaagatcttgagacaattaaatatagcgaaataaccaagacaaaattaaaaaatattgcaactaaaatgattaatgaagctgtgcaggcttttaaacatgactccctcattcaaacgcagctggccattagtggaagaagaccaatgacttttgcccttgaaagtaatatcattaatcttccatttgctaactacaaaaaaattagtaatttttgtaataatgaagatgagtatgaagtaaacatctattttgaaactatttcagaatatgtaaatgtttctcacttccgaatcgatattctggggtcaagtgatgaaattgtagctgatccagaaaagtatagtgcattactagtaaaagcaattgaagaaaaaattgaagtaattcgcaactatcaaaaacccgaaacaaaaactaagaaaacaaaataaggagctagcctttatgctaactccttattttgttatttcacgcatttttaggatgggatgggcgttagtgtaaaagaagaaatcctcaatcattgcactttccatcagaccagtggtcaaaattggatctaaagtttcgacattttccggatattttggctcttgacctaaattcataagagctttatttaaggtgtaatgaatataatgctcaaccttatcttctagatcagtatgcttatacaataatttaatatggcgaagctcattgtcatataatttatcacataaatcatatacccagtcatgaacttttttctgctctttcttaggaagtttgaaaaaatctcgccgaaacttaattcccgtataaataccatttaaagttgtaattctaagagcatacttaatcaattcggcagttctaggcaatttatgctgtccgaataaatataatgggccaaaaaatgatgaatgataaaggccagttgagagaaaaacgtgagcagcttttttctgaatagtatttcctgattgatatactgtatttagaagtttcatctttttttgtagataaggattttggtttgcccattcataggcatcttcttgttttttagaatcagaaaattcagctaatacatagctatatgccttattattaatagattctagatattgaagtgcattatatacagcaacttcttcagaattttcagcatctttttttatttcggatagagctactttcatttggagagtagaagagagcgttaaagagccaaaactgtgcaaaatcacagtttgttcgtttttagggagatgaagaaactctttctgatctttataaattggaacacgacgaggttcgtaaacaatatcatttaatctcgcccaagcagaacgatctacttgttcttctacagtgttccagttgtttgctttataataaggttttttattcatttttctgcctgaagtcacttaagaaactaatattgctaagagctggattttgaattggtaaatctttttgtgcacctttttctttttttcgagcttccataacaatttgacgaacatttttgacgtcagtcgaattgccactaagttctagtaagtaaagaataggcacatgtaatgtaacagagatcttttttgctgtttggccaaaaagatcgttaaagttacgattaccacatccaattaatcctaaaagattttttttattatctttatatgttaaaaaatcaacaacggaatccatcataaaatcttgatatgaaggtaaaatcaaaatgtatttatcattcatttgatattgaggatgagcatcctcaattcgatgtgcatcaagccccgttttatctatgaaccgttgcgtttgtcctgtaattgtataaaaagctatttttaccatagttttgcctatcgttatataccaaaactaccttctacatattcaattgtcgcgatttttaaagttaaagtcaaatcaaaaaaagttttaaaaacggcaataagtaccgtatacttaacttaaagaaaatggaggttccttatgacacttggatggaatattttaggtattttggcctggttaatcctggttttatatttaatttttattgtacaaaatattcgaaaacgtcacttaataatgattgttaaagatcgtaaacgctttgagtggaaaactaccttgttagatattttagaagttttacttcttttatgcggtgcgatctatatgtttagcatcactttattttacaatcctgatttagaaaataaacaggttttatctagtaaaattgaatatcaaccattaattttaacagcgggcaataaacgctcatactatgtcaccgctaaatctgacaataaaaagactccaattcagacatatactttttatagtaacggaaacagagtaactgttacgagtaattatgctacaatttctgacggaaaaaatccaatgtctgttcaagcgggagctattccttattcatctaagcaattagtccaagcagatgcacgctaccaaaatgcttatgtggctacttatacggctacctataagaaaaactggcagaatggtttaagaatgcatgccggtaagacagcagctaggtactacttaattagagtacctgaccgtacttttgtaagagaattaaaataataaagataatttagcaataaaaaggccttatttcgatgaatacaattcgaaataaggccttttgtttagttatttggaagatatttctgaataacgactatagcgaatattttgcaataaaaatcctaagataaatgccattactaaagttgctgataagtattcaagtacattacctgcataaaaagcagcaaacaagataaatccttctgatagtaatagcgaagagtttaaaaaggatcttacttttttattgaacagccaataaaagatgccatagcctagaacaaataagtaaataacgtctaagaggatgactcctaatattcccattgaataatattgtgctaaaaagtctcgctctagtggggcaatattattttcacggctaaaagaaataccaaacaatttatttgatttgtttttatcagttttcatgacgcggtttaagatatctttttctagatgtcgataatttaggcgttcatttgctggtcttttcatcacttcaagccagtagtatggatcattttgataagtgtaatgctccaatactagatcatgttttaaagaatatacccagtaatttttcttgataaattctttaagatagtcttcttgttttttgcctttatatctttccaatccagcattaagttcttgatcaagcctctttttgtcgccaagattacttctcttttgagctacaccactttcaagtgaagatcttctgagagttggactataaggaaaaatagcagccgaagcagttagtatacaaattaatgtaattaagaatttggctgaaaatctagtattcttcaaaatcaaactatggattaagaagactaatacaaataccactaagctaataatcagtccgaaatttccaacttttgttccaagcattaacattgctaatgcttgagaactcactagaactatatttaaaacattaaactctttataaagaatatagagcataataggcatgatcatgaacaaaatagctgataaagtattagcttgaaagaaaactcctttagaagctaaggcattaaaaggataatttgtttgagtaaaccaagaaaaaatattagcactaattcttttagcttcagtagtatggtatgaagttaatgagaaaagaaatagattcgagataacgattgttaatgaatatatgcctgaaataccctggattactcggaagaagtatttagcctgaaattcgctatatgaagtgatatagataacaatcaggggtagacaagctctcactagataaaaaatttcaactttagctgaataatggaagcctgttgcgtccacaccagtaaaattttttaccgaaattaggtgacagattgagtataagattaaaactccaatataagctataatccaccattgttttctgaatctttgccaattatttttgatactaaagaataaaataatagcaataaaaactcctaagactctcaaaatagtaggtattgaaaattttagaagtggtggcctagataaccaataaatatctaaaaatggctgaattaaaataaaccaaaataagaatgtttgaagccgttttttcatgtgattttaggttcctttgataaaacaaaaaattatttaggcttaattttattttgattctttatcctttttatcaggttcaactttagaaatctttacatcgtttgttgcggcagtctttccacgggcaggtgattttaccttcttcaagctcttgaagttaatgaccattttattgtttaattcattaactgaagattcatcttctgggtcatatgaagtaatagctagtaaagcagaattttcataaattttttctacttttccttgaaaaggatgcttaagttcttcctcagaagtagcagctaaaatttgaccaatttttacatcagcttttttcatttaaaaaactcccttttctgtacagaaatgttttacaatagtgaaatactattatatataatagtcgatttcaagcgggagagtaatattttgcaaagaattatcataattgcgggaccaagtggagtaggaaagacaacagtctcaaaatacttaacggaaaaatataatattccgcgtgtagtaacacatactactaggccaattagacaaggagaaattcctggaaagtcatattattttgaaactgatgagagttttaaaaaacttcatttctttgaacatgtaaaatatggggaatatcaatatggctcaagcaaagaagctttagaaaaagcctgggcaaagaatgacttggtttctttaattgttgagactgatggagttaagtcctatttagaaaaattagggaagcaagcatattttatttatttaactgtttcagatttttcagttctaaaaaagcgattattaggacgcggggataaagctagtgaaattgataaaagattaaatagttttgaatttaagcgtgatttacatttgtcagatgaacttgctgaaaaagcacatgtattaaataatgacaactgggaaaagacagctaaagaactagataagatcgtaaaaaagctagaaaataaatagattttgaatatgaaaaaggttgataataagctaaatgtaatgacaatgatttagctttgtaacagggctgtaatatttataccctacaataaccattgtcaattaaaaaaagaaacacatagcataactttttagttaattaatgacggctatgttgataattaagaaaatgaattttatggaggaataacccttgactatcaaatctaaagtaatcaaatttacaaccgctgcttcattcgctgttgcaggtattgcaactttaagtgcagctaaattaaactcattatcttttaacggtactgctcaagcttctactcttcaagcacctgcaaaagaaattggtgttgtaaaggtaaactctaagactggtgaaagtgttgctgtttggaacagctacgaagatggtaagcaacaaactggtaagtacttaccacaccaatcaagctggaagacatacaagaaagttaagactgttaaaggtgaaacttggtacaacttaggtggaaatcaatggatttcatctgacaacgttgaagaagaagctccaatcgcagttactgctgacttatctgcagttgctactactgtaagtcaagttcctgcagctaacgttgcaaacaataatgctgcacaagctccagcagcaaacgttaacaacgcacaacaagcagcaactactgcttcagttaacactgcatctgttgcaactactacacctgtacaaactaatactgcagcaactactaagcaagtatctactgcttcaactcaatcaaacactacttacactgcacctgcacaaaacaacactgttgctaagcctgcacaacaacaagctcaaccaactcaacaagcttcaagtcaagcagcaactactcaaactgctaagccacaagcttcaactcaatcaaacactacttacactgcacctgcacaaaacaacactgctgctaagcctgcacaacaacaagctcaaccaactcaacaagcttcaagtcaagcagcaactactcaaactgctaagccacaagcttcaactcaatcaaacagcagtactgcacaaactgtagttagcgcagcacaatcacaaattggtaagccttacgtatggggtgcaactggtcctaacgcatacgactgctctggtttagttcaatacgcatacagccaagctggtaagaacgttggacgtactacttaccaacaagctggtgcaggtcaacacatttctgttagccaagcacaagctggtgatatcttaatgtggggtgactaccacgatgctatttacgtaggtaacaaccaatacgtacacgcaccacaaccaggtcaaaacgtaactcaagcttctatctcaagttacttcatgccagattacgcaatccgtgtaaactaattaattgaaataaagatagttattttagaaggttaatcagaagattaaccttcttttttatgatataattaaaagaacttttttaaggaaataggtatttttaatgaataataaaaacgaagaaaaaaatacccatcccacaaataactatcgtaagtggctaataggtattttaattggcttaataataattttaataggttggttaatttttggtcatattcagtctaaaagaaatgctgaagcagaaaaatttaattctacccactttaattcgaatgttgtaatttatgatattcctgttggaaagctaacggtcaaaagagctactgcaaaaataaatgaaaaggcaaaaaatgatgcgattttagagggagataaagtcgtattaaagaagaccggtaataaagtaattacgagtaaaaaagttcaatcatattttgaaactcaatatactcgctaccctagccgaaagaaatggaattttcaaaatgatgctttattaaaggcaaaggataaattaaatcagattaaagatcggcaagtaaaatatactgtaaatggcaagtcttttgtatttaaaagggcagaagtatttccaaatgtatcatatagaaataataagtacgtatttttagatacaaaaattctagaagataaaattaacaacattaacaaagaagtatctactcttcataaatcttatgacttcaagcttccgaatggtcaagttacgaaggttaagaatgaaagctatggatgggcaattaatgaaaagaaattattagcgggtgttgaggatgcattagccaataacgttcaaaaccttaatggaaaaaactatatctatggtgaaggttttagtacctatggaactggttatggtttaagcaataatggaattggtaataattatgttgttgtttctttaactgatcaaaagctgtgggtctacaagaacggtaaatgtgtgctaacattagacacaattgttacaggtacagtggaaactaagattgctcgtaagaacctagaaacacctactggagtttggtatattcactataaagaatctccaagtgttttaaagggaacaaatgatgatggttcgaaatactcagttgatgtgaaatactggatgccatttacattaaccggttgcggcttccatgataatagttggcgaaagaattggtcaaaaacagcttatctaaatgatggttcttatggatgtgttaacttaagaccaagtgatgctcccaaagtttgggataatgtagagaaaaacgaagctgtaattatttataaataatatgaaaaaggcgtagattttaaaatctacgcttttttgtttgttaaacggtcttaattttaaatttttctagatcttttggtgatagtcttactgtaacatgaacgccatcatctttgaaatcttcatttaaaatttgaccatattcatgaagataggctaaatttttaccgtctgataaaggtaagactaagtttaccttttcgtaattatcaaaaacttttttaacaattaaatcagctagttgcttaattgattcgggatctttagctgaatataaaatatcatttccctcaatttgtggataattgcgatctgttaagtcagctttattataagcggtaatcattggtacattggtaattttcaactcatctagaactttttgcgtcgttttaatcatttgaaccatattatggtcggaagcatctacgacattgattatcaagtcagcatctttagcttcttgcaaagtagctttaaatgattcaattaagttatgaggtaacttggagataaaaccaacggtatctgaaaggataaaacttaagtcatcttttaagtcaattcttctaacactagtatctaaagtcgcaaatagcatatttttttcaaatacttgctttttagaagcttcctcactaaagacattcaacaactcattcatcgttgttgattttccagcattagtatagccaacgagggcaacttgtggcagacgggaattgtttcgtctagcagactttatttcttcctgtttgctaatatcttttagttcttttttaattgcactaatttgtttaccaatagttcgtctatttaattcaagtttagtttcaccagaaccacggttagcaaacccaccacttgcaccaccagaaccacgctgttggtctagattgttttctgatggatgaagccgaggcagttcatattgtaatctagcaagttgaacttgtagtttagcttgtctactacatgcacgattagagaaaatctctaaaattaattcagttcgatcaagcacgttaagttttgtcatactctcaatatttctaatttgagttggcgaaagttcatcattaattactaaggttttagcatgtaattctcgagccatgtttttaatttgattaagtttaccaacgccaaaatatgttcccgcaacgatattctcagccttttggcttgcttgaccaacaacatctaggttgttggcaagtgctaattctcttagctcagtcatataatagtcaaaattaggatcatttaaatttacgcccgcaataaatgctttaattttttttggttgattgtcgatcaaataattcacctgctttcaaaaaatagtatttctacgtggagttaataacttaaaaaatcatcataaccattcctttatttgatagtatgaaaattataatttctttttaaataaaaatcaattttgacacaaaaaaggccactccgaaaaacgaagtgacctttaggatatttgaacacggtaatatccgaatagagataattactttaattaaccgtgcacataaatatgagtggagtatatagttgttatcctgaaatcataataaattttatacttgtaaatgaaattaaactaactgtatcaaaggtagttaattaagaaaatcacttaagccatacaattatgggggaataggaaagctcacgacttaagggtatatagggtgacaaatttattatctttgtaatacatagtttaaactgaagctatacactaaaatatatttcagcttcctgaagaatttagttaaactgtatttttactaacaataactttcactatttttaattttattgaactatagatgggaaaaagtagtgaaaatagtgaatgattattatgattcagaatgtcaaaaacttcttcttgatataattactaaatatttatataaagtaatagcaataaatatatgttatttattacttctctatgaagactgccttcatttataaatataagaccttaatatcagaatagcaaataaaaggctttcacacattgttatattattaaagtataacaatttatcgatgtaacaaaataaataaaaaaataattaaatttttattgaatattaatttatacgatgatatgcttataaaaaatcaaaaagaggtaatgctatatgttagtaaaagtagtaacaaaagatataaagaatttgaaatttaatccaataggaattttagaaaattatgacaaatactatatttaaagctgacaacattacacgtgattataaagataagaaaaaattatttcatgcaataaaaaatattagttttgaattacatgcaggagaagtaatttcttttgttggaccaaatggagctggcaaaacaacactcattaaatctatttctaattacttagttcctacttcaggacaagttgaagtagaaggtgttgatctgattaagtacccacgaaaagctaggaagaagatgggcattgtttttggtggtgatcgtggattttactacggtgctactgcgagagaaaatttagaattttttgctcgagtcgtaggtgttaaagaaagaaatattaaaagcggtgttcaagaagctttgaagactgttaatttagtcgatgtagctgaaaagaaagtatctgcctattctaaaggcatgctgcagcgacttcatattgctcgtggattagtaaatcatcccaaaatattaatgttagacgaaccaacagcaggcttagatattgaatcagttatttcgattagacaattagttaaaagaatagcgtcagaaaaacgaggtattattttaactagtcacaacatgtcagatattgaaagcttggctgataggatctttttaatcggcggtgggatgattcattttgaagggtcaattcaagaggtaaagaaatttgctggtgtggaaaatgatgcaagtttagctgatgcctatttagcggtagctgatcagttaaaaagaaggcaggtgtaatatgtcttttattaaattagcattatttcaagtacgcttatacataaaaaatacttattttgtaaatttagtgattattgaaacaactacaatgctactttatgaatatttggctcactatgttttgcaaacttatgacggtaaagaatggttaattgcgggagtaatgggaacatgggcatcatgtactactagtgctggtgcattaggttttcagagatttcaagggacgctaccgtatctattaaatactggggtagctagagaaaaagttttactggctactctgattccagcttctgtgtatggtttaattgcttttcctttagcaggattagaagcttggttattaaaaatgccagttaattacttagattttcaattattagtaggaatcatcttattatggattgcagctgcagttttaagctattttattagtttatttttcgttttaagcaagaatgcaattgtttatgaacagcttttattattaccaattttacttttatccggacttttaagtattccagacgcaattagaacaagtatcaaatcttttcaaatgctaagtccgttaactttaccaattaggattatctatcatgaatctattcaatggaattggataatgagctacattttagttgtagtggtctttggagttttatctaaattaatgactaatattgtaattaaacgatcttttaaagaggggagattgagcatattttgaaagctgcctatcgtgttactctacgttcgattggaacttttgacggtgttaacgtgattttagttaattatttactgttacccttagtatctctaattatgtttttgttgattgcctttggagcgagtcaagattattctcggattttggtcggaagcgtgattactacaggtatttctacaggtattggcattgtggtagcatccacagtttatgatcaaaatatcaatttactggacgatattttttcaattagacctacttttaaaaactattggctagtaaaatttgtaattgcggcggtcgtactttctttagaaaccgttcttttgggagtaataggcctgctagtacttaataaaataaatattatacctagactttttctggctttaccatttgaaatctttataagtgttctcttagcctatttttgtgctgtatggggaatgaaaaaagagaatccttactggctttctaatattgtaacgggtagtttgattattttagctggaatgattattccagtgagtgaatatcctacttggttaaaattttttgcagaactacttccaattagtaatttaatagattggatagaggcaaatagtttttttaatcaagatatgttaattttattaatcaaaattttagtttggtatctagtttgtttattaagtactaagatatttttctctagaaggcaagaacgataattaattgcaataaataaaaaatgctattggctcaagtacatataccgagagtcaatagcatttttatgttatagattaattttcctttgatctttgccacttagcaattaatggtaaaacaattcctaatccaatcattaaaagaggttcgacaatgtttaggattaacatatgccaccaagtagctgagccagcttttgcatcaattggaacgattccaaaagttgcgccggtaactgtaatgattaaacaccaccaaccaacaataacagcgaaggttttgttcttgataaatacatattgtgatgggaatttttctgggtgaagtctgatcttaataaaggcccagaagagtagaccggtaacatatggtgatacaattccgtttaaattaagtaattgattgaaaatgtcattaactgaaggaagagtagcacttaaaaatagtaaaactgagcaaattccagttgttagccagtaaccattaattggtagaccatttttatcagtcttagttaattgcttgggtagatattttttagcagtgtctgataggaaaattctagctccgccatctactaaaacagctagttgggcaagcatgtagagagcttgggtaataatgaaagtatataagaagaatttacccattccgaatttttctcccattgcttgaaaagcatagtaggaaccattcatttttaagtcatctggtaagtgatgtgcattaaagaatacgcccaatgcaaaggaaccaaaaatagttaaaaatccagtcatgattgctagcatgtacattgctttagggaaattcttagggccatctttcatttcagtaacgtaaggagcaacaaattcagctccattcatggcaaaaatcaataaacctaatgacattaagaatttcatatcaaacgttggcaagaagttcttaaagtggaatggctgcgtagcaattgtgcgcccttcgccaaggtagacaatagtcatgattacgaaaagaattgtcatgataaacattgcaccgccaccgataatggatagccattgcaatgaattagcaaagcggtgttggaaaaagataaagatgacaaaaataattgccgtaaataaagcaaaagcccaattactcatttccttgtcacttaatgcatgtcccttaaaaagccatgcaaaagaaacaactgtcgaattagctacatcaactaagtaaggtaatgaaactacccagtaacaccaagcagtaatatagcccattcgatccccagaggtgtgtcttagccaagaagataagcctccaccatcatctgaaaaagtagctcctagttgtccaacgattaattcgtatggaactacaaatagaattaacagtaagatccagtcactaactacagctaatccttgattttgaaagttatagataatgtcatcaaaaccaataactgtaacaaagtccattaaggcaatcacgggccaagttagttttttacgtttttgtgcctcatcaaaagtatccaaaaatattttcctcctaaaaatcctatactattatcatttacataaatttaggaggtgggttgaagaagtggcttccctgcattctatacctcatttcatattttatttataattacggtttctattatacaagaagaaaagatgaaaaaattgaaaaacaagctttacttttttacacggtgtctgtattatatagtgtaacaggtacgtaatacactataacgaaaagaggagccaaaatgagtaaagtagttcaagttcaaaatattactaagacttatggtaaaaaaggtgaaaaacaataccaagctttaaagggcgtcagctttgatgtggaacgtggtgaatttgttggaatcatgggtgcatctggttctggtaaaaccactttgttaaatattttatctacattagatcaacctacaactggaaatgtatacattaatggccgtgacattactggcttaaataaaaatcaaatggcagactttcgtggtcaagaaattggttttatttttcaagatttcaacttattagaaaacctaacaaatcgtgaaaatattgctcttcctctttcacttcaaaatgtgaagagtagtcagattaatcctaaagtggataaaattgctaagcgactaggaattgatcatattttaaataaatatccagcagaaatctctggtggacaaaaacaacgtgttgcagcagcgcgtgcattagttcatgaaccagctattctttatggagatgaaccaactggggcacttgattcaaagagtgctactgaattacttgaaacaatgaaaggtctaaatgaaaatgatagagtttctattttaatggttactcacgatccatattccgcttcatatgctagtcgaattcttttcattaaagatggtaagatcggaaaagaaattaaaaaagatggtaaaagtagagaagaattttatcaagaaattattgcagaattaggtagacgttaagaatagaaaggaaataattatgctttggaaattatcattaaccgggattaaaagccggttcaaagactatttagtccttttttcaggcttaacttttgctagtgcgatcttttatatgttcatgactctagctacaaacccagctttcttaaatggttcactaagcattgcttttaaaattacccaaattgtttttggttttggaattgcattactttctattattacttttgtctatattgtatatgccaatagttttttgcttagtatgagacaaaaagactatgggatgtatatgatgctaggagctagaacaagtaaaattggaagattaatctttaccgaaactcttgttgttggcttgctagctaccttattgggtacagtcttaggggttggattaacacagggagtttccagtgtgttgatttctcagctaggattgcaaattcataaatttgttggtttttacttaccagccttactttggacaatagctttctttgcaattctgtttttcttagcagctttttggaatcgtcataaattagttaagtcaaacgtgattaacttacttcatgaagatcaaaaaccggttaaattacatagaaataaattatggaaatttattgaagcaattttaggaattgcgttacttgctgttggttactgggcaatgatgcatgcagcaaaattaggaacaaaaactattccaatagctttctttacaattgtttttggttcttactttacttttgattccttctttacagccattattgatttacttcgtaagaacttagcttacaaatataagaagttacattccttcactttaggacaacttaagtttagattgagcgattatactcgaattttatctactgtatcattattgtttgctcttgctttaggagcaattactgttggattgaactttaataatatgactgaacagtcaatgcaaagtacctattatgatgtagttctgtatggtcataataaaaaggtagataatcaattaaagaaagtttctgtaaaatctactacaacgtttgactataagatggtggtagaaggtaaaggaaaagaaaaagcgagagtactttatattccagaaaatcaaatcaagaataatcagatcatgtatcaacattattcaagaaaaaacgatatgaatcattatgatactagacgtattaaagcaagtgattttaagaataagactgatactaatgaagcacaatatcagttagtatctttaactccatatattgatgctcaagctaaagttgtgccagaaactcaatataatcaagttaaggctaaagtaaatagaattgagcttttaagagttaacaattttagaagtaactttaataatattgagaaactccaaaacttatccgcaactcaaatgatgagttcaccagaagttgataaagacgcagttaatgtaaatctctccaattctaaatcagcacaatatcgcttagtttcaagtatgacctctggttttgaatttatgggcttcttcttagggttagcatttttagcaatgcttgcttcaacattaatgttcaaagttttatctggagcaaacagcgataaaccaagataccaaatgctttggaaggttggaacaagaaagagcctcttaaaagcatctattgcaaaagaaattggaattttatttgctttacctgctgccttaggagtagttgacgttttatttggacttcaattattcaagtctattttagggatgaacacttacgacaaactttggattccatttactattttcggagttctttacgtactttattacttattaacggtagttttatatcaacatattgttttacaaaaagaagattaagaaaaaaggcttatcaaaatgataagccttttttctatactgacattttattataggaagtaatcttcatatccttgtcagtcatattcataattgtaattgacgcatttcttggaccatgggctaaattatattctccaggagcgaaacgagaaacaatacttctgattgtaaagccatgggtaacaagaagaatattttcagcaccatctaattgactaattaagtcaaaacctttatcgacgcgattccaatattcttccgcattttcagcttcatgatatggatctgcttctttcatgtagtccttaatcgtgttgatatccacttctttaagtagttcatctcgtcttggataaccgtgaggtccaccgatcatacgccatgcttcgtctgaattcatcccttcaaagaagccatagaattgttctctaaaaaatggtgttgcaatgtgttgcaactcatctcggttacaattttcattaataatataatcgcaagtatcactagctctttttaagtcacttgagatagcaatatcaaaaggaacttcactcaacgctttacctgcatcttttgcaccttggattccttcatcggttaggggtgtgtcacaccaaccctgcattttatcgtagcggttaatataagtttgaccatgacgaacaatataaattctcttcatttgtaaactccttgaataacactaatttacattataacaaatctaaaaaatcaaaattttaaacggtgtatataaaaataaaatcagtagaatacctactataactaataaaattgtgtttcttttagttaatttctgatgggtttcttcatcaattttattatttctaaaattacgacttacattaacttgacgaactattaaaatgataattaatactaaataaatacttaatccaataaactcaaatattttcattatgttttgtgtctttcatttatagcatagaagtattgtatcaaaaattttgaatattcggcctaagtatattaacttaataggtgaaagaagaggggtttttatgagagttacaaaattagtaattggaattttaatgattgtctattcagtttggctatttattcagggactactaggtggattcttggggataattgctgagaaaaacatggtagcaggaattattggagttctcctttgcggtctgtttatggctagcggtattgtttatgtttcaactgaaaatagtgatgggctaggcggtgatattgctggcttagcgatgatgattgttgctggaattctaggaattattggcggcttttatgctggtttaatttggaccggaattttagcattagtaattggaattggattctttgtttggcatttaaagacaagataagaagagatcggattagcttaaatagttaatccgattttttaggtcgaaatatttcatctatggggattaagtttgtacaattgagttgataagacctattattttgtgatggaaagaagaattattatgaaatttatgtcttggaatgtaaatggtttacgggctgctttacgtcatggctttgttaacacgtttactgatttagatgcagatatttttggaatacaagatactcgtgttgagccaaatgaagtaaaaattgatttaccaggatattatcaatattggaattatgctgaaagaaaaggctatgccggcactgcagtatttacaaaagaaaaaccaattactgtggctaatggcttcggtgttccagaagttgatggtgaaggaagaagcattactttagagttttcaaacttttactttattaatgttcaagtaccattttcaggagaaaagcttcaaagattagacttcagagaattatgggcacagacttttagaaattacgttactaaattaatgcaatacaagccagtaattattggcggagatatgagtgttgctcatgagagaatcgatttagctgaaccagatgataaccaccaccgtccaggatttactggtattgaaagaaaagaattttctgaattgttaaatgctggttttattgatactttccgttacttccacccagatgaagctaagtatacttattggagctatcgtgataaggaagctcgggcagaaaatcttggctggagactagattacttcctagtatcgaataatttggaagatagattaactaatgctaagattttaagtaacattatgggatcagatcactgtccaattgaattggatgtagacattactactagataaaataaaagaacataaaaaatgtactcaagaaaatgaaaacttgagtacattttttgtttatagagagattaaagttatttagtggttacggagtagacatcattatgtgcctcaactaattgtccacttgtcgcgatatcttcgacttgttcaactctctcactactattagtaatcagagtcataactgttggatcttttttagcagtttcaatttgttttagatccatttcaattaactgtgtctctggagttacttgctcgccttcgtttacctttaaggtaaatggcttaccttctagttcaacagtgtctattccaagatgaagcataacttctaaaccagagtcggttttaagacctacagcatgttttgttttaaagattgatacaactgtagcgttaaccggactataaatttttccattttctggtttaattgcaaatccttcacccatcatcttttgagaaaatacttcgtcattaacttgagatatatcttcaaaagtccctttgacaggtgccttgaaaataacttcttctgacttatgcacagaatttgattgaaaattagaagttttatccacttgtggattatttgcgggctgcatatctggatgtgcgataatgtcattaatttcttgactatatagatcggcctttccaccaaaaatagcttgaactccaccagcaacttttaatactccaggagcgcccaacattttaaatacgtcatcattaactaaactattatcctttaaagaaactctcaatctggttgcacaagctgaaacagtttcaatattttctaaaccgccaagagcagtgataatctcacaagattcgttgtatagtttgtcatcagtcttagggctgtttgacataattttttcagcatcttgattttcttctacaaccatccctggaataccaacatggaattttttaatacaaaaagtaaaaataaagaagtaaaggaagaaccagataactcccataattaagacattcggccaattagttttatcttttccttgtaagacaccaaagagaagatagtcaattaaaccgccagagaatgaatttccaattctaatattcatgatatcagcaacataaaatgaacatccatcgagaaaagcatggataacatataaccaaggtgctacgaataagaaagtatattcaattggttcagtaataccagttaggaatgaggttaaaccgcctgaaagatatagaccaccgttagtcttacgatttctcttaggtaagcaaaggtacattgctaaagcagctcctggaagaccgaacatcatagttgcaaaacgaccagcaaaaaatctagtaccgtaagtaaacaaaccatggtgattaggatcagctaattgagcaaagaaaatattttgagcaccaacaacagttttaccagctacatctgcggtgccacctaaagctgtataccaaaacattggataaattgtgtgatgtagaccaactgctccagttaaacgaagcaagaagccatatagaaaacttcccaaacttcccattttagctattgcataacctgcactggttaaatcgctttgaattggtggccaaataatgaagaagatagcaccaataacaatcgcagctaaagatgaaataataggaataaatcttgaaccaccaaaaaagcctaagaattgtggtaattctaccttgcgataatgattatgtaggtaggcaacaactgagccaatcacaattgcacctaatactcctgtatcaatagtgtttttaggtgaaaatagttggagtagtcctgagattgtggctgtatatactagataggcaacgccacctgctaagccagctgttcctttatccccttttgctaagccaactgctaaaccaattgagaaaataagagctaagttattaaagacagcacttcctgcaaaattcattatctttagaattgtttgaagccattcttgattaagccaaggataagaggtaacggcagctttattggttaaggctccgcctagtcctaggagtaagccggctacaggtaaaatagctattggaagcataaaggcttgccccagttgtgagaaggcttggccaatatgagaaaatttcttagacatgattacgcctcgtttcgttacgctcggttaattttcgaaaactgaagtaaaagttttagcaatttgtaatgggcgagtgattgctcctccgactacaattcctgctgggttgatgtcaataacttgctttaattgttctggagtatggattttcccttcagcaattactggaagacctgcatcaactagagctttaattaaatcaaagtctgggtgatcagttttaggactttcttcagtgtagccagaaagcgtagtaccaacaaaatcaacgcctgcctcataagcattttttgcttcctcaaaatttgaagtgtcagccattaaaagttgatttggatacttagtttttatttctttaatgaattcatttactgtcttaccatcatgtcttggacgcaaagttgcatcaattgcaattacttctacgccagtttcaactaattcatctacttctttcatagttggagtaatatagggcttttctggtggatagtcccgtttgataattccaatcattggaagatcaacaatttttttaatttgtttaatgtctctaacggaatttgctcttaagcctgttgcgcctgcttcttgagccgctttagccattaggggcataattccgccttcttctgtatagagtggttcgcctggcaaagcttgacatgaaataattaagccaccatggattttgttaataaattcttctttattcatttgtaaatatactccaaataaatattattttggagttttcctcccaaagaaataatataatgaattttatttttgtgcaagcgttttcttataaaagcatgatatagttataatcaggatgtgagacaatggaatttatacagcgatacaatcaaaataaagacaagctaactaagtcagaaaataaattggctaactatattgcgagtcatactgaacatgtaatttatgacacaattaagtcgctcggaactgcaactaacactggagatgccacaattgttaggctttgtaagaaattaggctattccggtttctcggatctaaaaatagctttggcacaagattcaatgatgactacctcaaaaggtcatgacgaagctcaaacatcttcagagttaagtagtaaagttttaatttcttcaattgaaaaaacagaagaattgatcaatccttctgttttaaaacaagcagttagtttattagctaaagcgcgtcgaattcatatttttggtttaggacactcaggtgaatcagctagagactatgaaagaacctggcttagaattggtttgattgccaatgcggagtctgatccgcatattcaagttcaagttgcgaccttattaagtaaagatgacctagtagttggcttatcactctctggtcatactaaagacacttatgattcactcaaagttgctaaagaatacggcgctaaaattattgctattactaacgatcttacgtcaccgattgctcaattaggggatgtaagcttgcagacgtcagttagtgaatttatgaatattggtaccgtagctggtcaggtatcacaattatatttatgcgatgttttagcgcgagaatatgaaaagcttaataaagttgatgtagataaaattaaggagcaggcacttgcagcagttatgaaaaaatctatttagcataatctgacaataaaaacagccaaactactcaagatagagtaatttggctgttttttatatttaaaatgtgttagttatttgattacagaaaagtagaaagcataaagttaattatgtctttatgcttatgtaagtgttaaatttatattttcattgtacaaggtatttgctattaagtctaaaaatatgcttgctaaagttctattaatataatgtgctaatctgtgactgattctaatgctcggctttgttgacgagctttaacagatcgcttgattagcttcattaattcaacttgtaagattgagaatagagaaagaatgatgactactagccattgtcttgatgtcaggttagtcaaatgaaagagagattgtaagttaggagtaaagagaataactcccattaaaactgctgaaacgataaaggatacaattaaccaaatattaattttgtttcctctaatccaaatcggatcagtattagaatgttgattaaatgcgcggaacatttgagataaagctagaacacagaaggccattgtttgaccagcaatcggattatcaaaagtgtctccaatccagtaagctaatagtgtcattaaggcaacaaagattccttggctgataacgcgccagactagatctctttcaaataaggttccagtcttcactggtttatgtttcataatatttttacttgcaggatctactcctaaagctagagccggtaagctggcggtagctaaattgacccaaagaatatgaacagcaagtagtggtgcatcccaattaaagagggtagcaataaataaagtagtaatttctgcaatattaccgactagtaaaaattgaattactttctgaatattgcggtaaacctttcgtccctctttaatggcggcagtaatagttgtaaaactatcgttaagtaaaatcatgtctgagacatctttagcaacgtcagtaccactaattcccatcgcaactccgatatcagctgcttttaaagcgggagaatcattaactccgtcacctgtcatagctactacttcttcatttcgctttaggctttgaataattcttaacttatcattaggtgaaacacgagcaaaaactgtggttgacttaactgcttgatctaattcgctatctgccatctcgtttagttcagtaccagaaataacagtatttccattagcataaatgcctaagtttttagcaatagcaaccgcagtatttttatggtcaccagtaatcataatagttttaatgcctgcttcgcgagccattttgattgatgctttaacttcatccctagctgggtcaatcatcccaacagctcctaagaaaactaaatgttgttcaatattttcattttcttgcggtaaattcaaaatggttcggctggcaaaacctaaaactctcagggcttggtcagacatcttatatgacaaggctaaaatgttttctttatcagtcttagttaatttctgcattccattgcttgtagcaatgtagtcacagagtggtagtaattcgtccagtgctcctttagtgtaggcaacatattcattgtttatttcatgaattgtagacatacgttttctaattgaatcaaaaggatactcgccaagtcttggatattcttttcttaagctggaaacagaatatccaaaatcttgtgctagtggaattaaggcccccttctgtagggtcaccaataatttcatcgggactagcaggactaagagaagcatcattacaaagactagcagcatacattaagtctttataagcattattgttttttactgctttttgagcctttaagatctttttgttaaggaaatcatctccgttagctaaatgagttactgtcattttgtttaacgttagagttcctgttttgtcagaacaaataactgttgcgtttccaagtgtttcaactgctggtagatttttgattaaggcatgttccttagccattcgctgtactccaagtgccataatgatggttgcagttgctggaagtccttctggaataattgaaatagctaaagaaattgctactaaaaattgtggtagaagaggacgtccataaaaagcgccgatggcaaaaattaaaacacaaatgattaaaccaataattgttagaattttacccacagcgttaagtttccgcttcagtggagtatcactagtatcatcgtcttctagcattccagcaatttgaccaatttctgtattcatcccagttttagttacaattccacttcctcgaccataagtaacaattgaagaagtataggccatattttttctatcgcctaagggacaatcaggagaaagaacagcagctgcattcttttcactggcaattgactctccggttaaagaagcttcagcaattttcaagttattggattgagttaggcgtaaatccgcaggcatcatatcaccgttggttaagataactaggtcgccgactactaattcactagctgaaacaattttttcagatccatttctaattactgttgcagttggagcactcattgtttttagagcggcaagagaagcttgggctttcttttcttggataataccaataatagagttgattatcacaatgaagaaaattacaccagcttctacccattcatttaagagggctgaaaaactggctgctcctaataaaattaaaatcattggatcaaagatttgctctttgagcatgtttaaaattgacttagggggcttttcatttaaaacattatgtccatatttttttaaccgtctgtcaacttctggctcgcttaaaccagctgagcttgtttctagatttgaaaataactcatcttttgtttgagaatacgcgggaggttgtttctgactatccataaaggatataccattcctttcttaatattaaaaaataatgatttgtatagctttgataaatattgttgtttatgaactcaaagctaattatatttatgcaatatagtgtaaaataactagtgatttaagtctaaaaatatgcttataataatatacctttgctatagttaagagagaaatgagggaaggaacatgaagcaacttgatcaatcatttattattggaatttttggcttaattggtctgtttattggcttatttgtcaaaaatattatggtttggacttttgttggaattgcagttggctatgtgataaccttttggattccatattttaaaaagcaaagtcaattaaaaaagaaaaacatgaaataagagcgactctgtgttgagagtcgctcttattgctcttggtataattttttaacatcttggacatcacttggttgaattgtgtagaaagatccttgtggatacataactgaaatcccgtctttatgacctaatcctattgcatgccctaattcatgttcaactgtattcacaatccggccattattgtagccgtagcttggatttaaaagataatatgaatttaagcgaaccgtagccttaagtaaatgcccagttaatgagttgtattgagtatcggttagtccggctgcatttgtttcaccgtcattcattgacttaataataattttggcgttatttctatcatttgtgattttaaaattaaaggcacctgtgttattccaaacgttaattccatcaagcgcagcttgttttagcgttggatcagaaagatcgatgtagacagtggctgtattagagtcaaaagtatgtcctttagaattatctccatccttatcatcattttggattttttcaggtgaaataaattgttgtacttttgcagttagatatgggaggggatttctagttccaaatgttttttcaatttctggagcagctttttgataggcgaactcaagccccacaaaaaggagggctagaactagaattgttttaaaaaatcgtttcactttctcatctcgcaatgtaattttatttaattataaaactaattatttaagaaaagactaaataacagttgagactttctgaaaattataaattcttttagaaagcgtatacatatgataaaataatatgcaacgtttttactaatactagaaataggtgacgtaattttggtaaaagaaactgaacaacaaaaagagcaaaagcatctagatgatgttcttggcttaattaagaagaaagaaaaagagcttgatcattcaatcgaacatgcacaaaatgaagctcaaaatatcaactcacatttttttgatgatgtgaaattagattacgatggctactccacttcaatggatactgcactgtctattcaccagcaacaacaaatgttagcggaacgacaaaatgcctggcaacattcagctaagcaattatcgaccttgcagcgtttagaaaagaagccatattttgcaagagttgattttcaagaacctaatgaagaaccagaaactatttatattggattagggtcttttgcagataaagaagatcattttttaatctatgattggcgtgccccaatatcatctatttactatgatggaaaattaggaaaagtatcatataatgcaccagatggtgtgcaaactgttgatatgactaagaagcgtcaatttttaattaaagatggcaagattactaatatgtttgataccaatgaatccattggggatcaaatgctcttaaatgtcttgaatgaaaaatcatctacacagatgaagtcaattgtgactaccattcaacgtgagcaaaataaaattattagaaatactagtgctgatcttttatttgttcaaggagctgctggttcgggtaagacatctgccattatgcagcgtgtggcctacttactatatcgctaccgtggtaatttgacttctagcgatgttattatgttcagcccaaatcaattatttaatgattatgttaaaaatgttcttccggaaatgggagaacagaatatggttcaaatgacttactggcagtttgtttctcgccgtgttcccggaatgaacgttgaaaacttatttgaacaattcgaagataatgagcaaaacgataagattgttaacttgaagaattcattgcaattctttaatgcagtaactcgctatgctaaacatcttgaaaagaatggtttggtttttaagaacatttactttaagagtaaggaaaaaccattttttgataaggaaaagatcaaggaaatttactacggctttaatgaaaactaccacttaaggaatagaattgaagctacaaaagaagctttgattaatagcttaaaccgcagaattgaacctgaaactaagaaggcatgggttgataaaactattgaatccttggatcaagaacaattaaataagctgtatgatcgtccagatcaagaatttgaatctagtgcaaaagaagagcactttttagctcgtaagattgtaattaatcaattaaagcaagttagtcgcaagatttgtcagaatcgctttttaaatattcgtgcacaatacttacgctttttacgtgccgttcctaagataattgacttaagtaaatgggacattactcaagaggagtgggatgctcatattgaaaatgttaaagggcggtttaaggctggaagaatcaagatggccgatatttctccttacctttacctatatgatctagtaactggacgtagaacagattatgaaatgcgctatgcctttattgatgaaattcaggattacactccattccaattggcatatcttaagtacaatttccctagagctaagttcacgatgttaggtgacttgaatcaagctatttttactaaagatgaaagtaaaacacttttgagtcaaatctctaaattgtttgatcctgaaaagacggatgttgttcaattaaccaagtcttaccgttcaacaaaggaaataactaacttcactaagcaaattttgcgtcaaggtgaaaagattgaagcttttgatagacgtggtccaaagccagccttttacaagcgcgatagtattgaaaaagaatacagtgccttagaagatatattggccgaaaacgatgaacaaaagctaacaacagcaattattactaagacattggctgaagctcaagaagttgctaaagtattaaaagaaagaaagattaaggcaactttaattgggtcggcaaaccagcgtttagtaccgggtactttagtaatgccatcctatcttgctaaaggactagaatttgatgcagtagttgcttggggtgtttcaaaagaaaattatcatcaattagatgaaactcaattgctttacaccattgcctcgcgggcaatgtataaattagacttgatttatacaggtgagaagagccctttgtttgataatttagatgaaaaaacttacgtaaataagtaaaaataaaatccctcttagatcttggtaagagggattttttattattcaagtaagcagataagaatttaaagttaattctatttaattcttatgcattttgacagacttaatacataatagttaaaatacttagcatgaaaaggttaaatagagccagaaaatatcggcgtagaagaagaattctgtatacagttatattgttaattactgctggggtaattgccttaggatttaattttaaaagatttcaaaatgaatatgattggcttactttaaaaccagaacagaagttaaatgttcccttagtaaaccaattaccagacttaccaaatggttgtgaggttacctcacttgcgatgttgttgaaatactatgatattaatgtaagtaaattagagttgtcatcgaatatcaagcatgtatcgtcttttgttggcaataattatcgaggaaatccacacgttggatttgttggttacatgagtatcaagaatgcaggctggtgtgtgtataatgaacccctatataatgtggctagaaaatacacaaagcgaatccgcaattatacaggtaatgattttgttcaggtattgaaattagtttctaagagacatcctgtagtaatcattacaactttgaagtttgatcgtgtaaatgatatgcagacctggtctactaagcaaggaaaagttcacgtaacgccgtcatctcatgcttgtgtgattacaggttacaacaagaaaaaggggattgtgtatgtaaatgatccttatggcgttaaaaataaaaaggtaagcttaaagaagatagaggcaagctataaccagcaaggtaaacaagcactttatattgaatagagcagtaaaaaagcatcccgttattgggatgctttttatgatatagcagctgtttctttctctttgactaattcagcaagcttttcaattagtaatttgttaccttcttgatttaaatggataccgtccttctgaagtaaatcatttggatgaccggtcttacgcattacttttgcaaagtttaagaatggaatattattttcgatatgacattgctcagctactaattcaaattgtaatgtttttggccatgcttgatctttggcgattttccaattagtataggaaggtcccattaaaattgttttgtcgacaccaattaaatctactagaacttgcaagttatgtgcatagcgtccagcgcttaagccaaattgcatgtttgcgtcattagtacctaaggcaagtataaccaagtcgtaattgaaaggtttaatccttaaatcataaaagtcaattgcctcctcagttgtacttccaggtacagaattattaataattgtaaaattaggtaatttttcttgcagtccttgagttacaatattagttgcgtgtccatcaatataccctgcaagtaaggaatcaccaaaaagaataatttttttcatagatatcttcttttctttctctcaatatatatgataggctgaacaatgtaaaaatactaggaacaaggcagaaggaaggcgggctttttatgcaagagcaatttttacacttgacacctgataagtggcaggcattaattcctccaagtgatgaatttagtgcagaaattttcatgatgaagaatcttcaatatatcatgagtcaaaaaaatgctgtttatcatactcaacaaacattttataaagaacagtggcaaaagattccttttataattggagtaacaggatctgttgctgttggtaagtccacctttgccaagaaaataacgcggttatttgaacgccttgaaccggataaaaagattgctcaagtttctactgacggatttttaatgtctaatgcagaacttaaagctaaaaacttaatggatcaaaagggcttcccagtatcatttaattgggatgccttttctacttttctgtcaagtgttaaagctggtaaagaaagagtaccatatcgactatactcacaggaaatttctgatctagttcctaatgaagttggctcggttgaacaacccgatgtcttagtagtagaaggaataaatttactagaagttcctcctaacggccaagcaccgccaagtgatttcttagattatgtgatttatctcgatgctagtgaagaagacttagaaagatggtatcttgatcgctatcatttaatgttagaaattaatcgcaataatccggacaattatttttatcaatgggctcatgtaccacgtgaacaagcggatatttttgccaaaaaagtctggcgagatgttaacttaaagaacttacacgagtatattgaaccaactaaaaaacgagcagacatgattattaaaaagtacggtaatcatgaaattagtgatatgtatattaagaaattttagaggtatttgttaatgcaagcaattgaattaaaaaaaggtatgatttttaatcaagatggtaagttgattgaagtattaaagagtaatcaccacaaacccggtaaaggtaatacagttatgcaaatggatttgcgtgatgttatgagtggtgcagttgtgcataaaacaatgcgtccaagtgaaaaagtagacttagttaatgtttccttgaaaaaagcacaatatctttacgatgatgacactgactttatttttatggatacagatacttatgaacaatatttaattcctaaagaacatttagcttcagaagctaaattcttgatgccaaatattgaagtagaccttaagttcactgatgaaggtaaattaatcggaattaacttaccatccactgtaaagatgacagttaaagaaactcaaccagaaataaagggtgctactgctgctggtggtggtaagcctgcaacaatggatactggcttagttgtaactgtaccagatttcattaaggaaggcgaagaattaattattggaactgaaaatggtgattataaaggccgtgcagatagtattactagataatcgaggaggaactgtgtaaaagcagttcctttttctatataaaaattttgctaaatttgtctcactcgattttagacagtccttataaaaataagggctgtttttagcttttataattatctgactggaaaagtatagaactttattaggtatgaaacataaggtatcaattattaaataagataagttacttaattcttgactatcagtaaatgaggttctatattgtgtggtgaaaaggcttacttaatttgtggaggagacaaataatgttatccagaaataattatcaagaaaaattcgtaaaatggaaaacaaaaaagagcggttttcaattaggaaattttcaattggagctgcttcagttttaattggatttactctttttggaattggcgtagacagtcaaagcgtaaaagccgatacagttactccaaatagtgtaaatgtaaaaaatgggagtgaagtaaacaaaacagcagaagtactttcgaatgagaaggggaaaaatgctaccaatactgcagttaatagtactgtaaaatcacaaaatactgtagttaatactgtaaaatcaccagctgctgttcaaactaaagttaataacaatactactaataatacttcacaagaaactttaaataaaagtgtagcaaatagtcaaactgaaaattcagaaaaaacgaatctgactgcaagtaatcaaaataatacagtaaagccaattgttcaaaaggcaaatgttcaagcaactaataatcaaacagaatcagttaatgattattctcaattcttaaacgctttacaaaataaaaatgtaagtacaattactttagataagaatattgattttagtaatgctaatttaaataatggtagctatcaggatataaataactatggaattgctcgtacagtaacaattgatggtcaaaagcaatattctttaaacatgggagaaaactatattgatcttgacagtaatacctactatgagccaaacgcaagcaatcctactcgcaattggaatgtcattttaaaggatctaaatcttcaaacaactagtggatatggcccattttggtttaacagtgcaacctctaatgatagtacattgacctttaatggagttacaacaagtaaagattccggccaattacttaataattcaactgcttcctcgtatcctaatgttaacgttaattttgagggagagaataaattacaaggtaatttaactaattcgaatattacgagttccgctttaattcaagcaaacaatgttaactttagtaatgggtctactgtatttactgcaaataataatagttcaagtaacttagcagatatcctagcttcaggtaatgttgttgttgatagtagtgcgcaagttgattttaacagtgaagctacttcaaatatggcaggtgtttcatttgctaatggtgctggcgatcaaacaattgacaatgcaacttctggagtatttcgtttaatgcctaatgctcaagtaaccatggaattaggttctggcgcttcaatgggagttaataatgcaagtaaccttgacttgcaagattcagcttcattaaaaattactactagcaagatgaatagtaccggcttccgttccgctggcttagtcggattggactatgatggtgacactaatgacagtacagtaagaattagtccaaatgctgttctttctatcattagaaccaaggtaactgattctgatgctcctttacttgcaatgggaccaagcagtggagatggtgaaatttatcatcttgaagtaaatgatggtagtttgaatttgcaagattcagcttactcatcttacctaccttcctcctataccttatctaagagtcaatattggggtggctggccagctattttgactatgtggggaacgagcagtcaaaactacattaatttcagcaatgcgaagttaattaatttacagcgtactgcacttaataaaccaggatatttaattaaaactgaaggtgcaggagactatgcatatcaccagacccacattgtaattaattcacctgatagtacctacaatactccattgactataattccagctggtgaaacaaaaccggtaacttggaatgttaaatatttgaataatactagtcaaggtggggactatgcgtatgcctttcgttcatatcgcgattttggtgattggaacaatgccggttctgaatatatgaatggatcagttaatgacgatactccagccaaaggtgttaatgaagttaccttaacagctatggcctccgatccaggatctaatagcttctctaatggtgcagttgttcctgaaggaaatgaaactaccgcttcgaaagctttgaatagttttattaaccactttagttggtggaatgcctctggagttaaatttggttcaaacttagatgaaagtaatcaatatactccgtcgtataaaccagtaaatgttgaacaaggtcaaactgctactgatgatccgtcatttactaatcaagatggcaaagatattactgctccagctggcacgacctttactacaggtactgatacacctgattgggcaactattaattcatcaactggtactgtaactgttaagccaggtacagatgtaactacaggtgcttacaatattccagtaactgtaacttacccagacactagtactagtgaaacgactgttccagtaattgttactaaagctggtcaaacagtaacttggggtgataatggtgcagttgtaactagcgttgacacttctaaacttaacgctcacgaaactactgaaaattcacaagttctctcaccagttggtatcgtaactgcagaaggttatgaattaacagatggtaaactttcaactacagcaactccaattactattgctccatcgactgtaagctggactacaactccagatactaatgttgctaccgcaactgcatcaggtaaagatatcacaactagtgttaatgttgactttactgataatgatgcaactaagaatatacttggctcaaagaatggtgttgtaactactaacccatttaccattgatgctaaaggggctggtgctaagactgtaactgctccagttaatattgtccttggttcggatttgactagtgaacaatttagccaattagtagataacaacatcccaactgatgaaattgcaaagacggaatgggcaactaagcctaatgcacaaggtcaagacggtgttatcaagattacctttactgataaagatgcaaatggtcaaccaacttacttgaacattaacattccagcaagttcaattaaggtaactactgatgcagacgaccataatccagaaggtcaagacgtttcaactaaggtaggcgaagttcctgatgctgaaaaaggtatcaagaatcctggtagtttaccaagtggcacaacttatacttggcaaaatattccagataccactaaaccaggtaagaaaccagcagttgttgtggtaacttacccagatggttcaaaagatacagttccaactaatgtaattgttaacgctaagccagagattaagactattactactactgttggtggagatccagctgctactgaaggtattgctaacttgaataatggtggtactactccagttgatggttatccaacaagtgcaacttggactactaagccagatacttcaaagccaggtgcaactactggcactgctacagtaacttatccagatggtactactgagaccgttactattcctgttgctgtaaatggtcaaggtgatgttactgttatcgataatggtcatgttttcagcttgcatgctaatgatgtagtaactcacaagacttcagacaagaacattattggtggaccagtaattgaaaactttaagttaagctactaccaaggtggtcaaagctacagtaagccatatatttacactttgaatgctgataagactgcatatgttcttacccaaactggtgataatccagctggtgtaactgttactgctccacaatctattaatgctagtgacattaagattagctggactaaagcagatactgttctattcaataatgcattaggtgcaatcaagggtaatggtcaaccaacaagtttgtcatcagccaacaatggtggaaccaagacgattacttatactaactgggtcaataatcaatttggttatcctaagtattcagctgttgttaacagttcaagtgtaaactggccaatttatggtaaaggtccagtatcaacttatccattcccatcagtttacatttacggtgccgaagctaatggtactattccaagtgtttactcagatactactgatttgaaggctgctttaggggatgcttcaaagcttgtaaatactagtgatttaactgctgatcataatgctaaatttagttcagttgactggcaaactttaccaagtcttgataaagctaatgctaatgcttctgcaactgtccggatcaactttactgatggtagttaccttgatgttccagtgtctgtaaatgtaatcaaggttgatcaaggtgttgatgataggactgacgacatttatcgtgatattactcgtacgattaatgttgaaggtgaaagtactccagttgttcaacacgtaatttatagtcgtgctaggatgactgatcgttctaagccagcaggtcaacaaaccagttacactgcatgggcacctgctaagaatagtgaaggtcaagcaataactaacttcccacaatatgaagtaactaagcctggctacactgctactgcaactggtgcaaatattgaaactgttgatggtaagcaatatgttccagcttcaggaagaattactgaagattcatcaaatgaagttgttaatgtaacttacgctgctaacgaacatactttagtaattaattatgttgatggtaatggtactgtagtaggtacttacaatgttcctggtaagactgatgaaacggttaatgttgatgtacctggaaatgttccaactaactggaaactagttccaaatcaacaaactatcagttcttacaagttcggttcaggtgatccacaacctatagcttacaaggttgaacacggtactgaagttgttccagttgacaagactgacagccgtacttaccggaagattacccaaaccatccaagaagtaccagctggtaagactgatgcggataagaaggttgtaagaactgcctcagttgaatttgaacgtactggtgtgaaggacttagtaactgggaagactacttggaacgcatggaactcaaacagtgaaactttcccagtttacaacattaaggaacaaaagggctacgacagctatgtaaatggtgttaaggcaaccgaagtagcagcagtaacagtaaatccagattcaagtaatattactgatacgattacttatgtaaaacaagctgcccaaccattaccatacgatccagctagagatgacatgtcagtaactcgtactattaactacgaagtaccaacaggacatgaagccattgctccagtaacgcaaactgtagaatacactcgtgatgttaacggtgtcgcaggttaccaagacccagtcacaggtaagccgacttggaatccatggcacgttaagagtggcaaagcagaatttgcttcaactagtgtagaacaaattaagggttacgactcatacgtagatggtacaaaagcaaccgaagtagcagcagctgcagtaacagaaaaagatggcgaaccacaaaacggtgcaactgtcacagtaacttatactgctaacgaacatactttagtaattaattatgttgatggtaatgggactgtggtaggtacatacaatgtccctggtaagactgatgaaactgttaatgttgatgtacctggaaatgttccaactaactggaaactagttccaaatcaacaaactatcagttcttacaagtttggttcagatgatccacaacctgtagattacaaggttgaacacgcaactaaggatattactccaactgatccaggtgttaacccaactgatcctaaatacaagaatatgttcactactgtaagtcgtgacatttaccaaactaaaccaggtgaaactaagactaagattgatactcaacacgttgatttcggacgtaatggtgttgaagacttagtaactggtgtagtaactggtaccggagactggaaagttggtaatattgaaaacaacaagttctttgaaggtggcaaagcagagtttgcttctgaaaatgctccacaaattaagggttacgactcatatgttgatggtgttaagtcaactgaagtaccagcagcatcagcacttaaagatggtcaaccagtaaatggtgcagctgttaatgtaacttatgtaaaagaagattcaactccagttccatacaagccaggtcaaaaagccatgaaccaatacgtaactcgtacgattgtggttcatgaaccaggtcaagatccagtaattcactaccaaactgttcacttcactaatgaagataaggatggtaatagcggctacatcgatccagtaactggcaaggttatctataacactgtatggcatgtggcaggtgaacttaaccaggcaaatggtacttgggcagaatttaatgcaccaacagttaagggttacactccaagtcaagctaaagtagctgctgaagaagttactgctgaaactaagaatgctactgttgacattacttataatccagtagctccaactggtcaaaatgtaactactaaggtcggtgaagtaccagatgcagaccaaggtattgccaacaagggtgatttaccagatggtactaagtactcttggaagacaacaccagatgtatctactgaaggtgaaaaaccagctgtagttatcgtaacttacccaggtggttcaactgttgaagttccagttactgtaactgtaactaagaacccaactgatgcagacaagtacactccagaaggtcaagatgtgaatactaagaccggtgttgtaccagatccagcagaaggcattaagaacaagagtgacttaccagatggcactaagtacacatggaaagacactccagatgtaagtactgcaggagacaagccagccacagttgtcgtaacttacccagacggttcaaaggacgaagtcccagtaaccatccacgtaacaaacccaacaacggacgcagataagtacaccccagaaggtcaagatgtaaacactaagaccggtgttgtaccagatccagcagaaggcattaagaacaagggcgacttaccagatggcactaagtacacctggaaagacacaccagatgtaactactgaaggtaataaaccagctgtagttgttgtaacttacccagatggctcaaaggatgaagttccagtaaccatccacgtaacaaacccagcaactccaaccgatgcagataagtacaccccagaaggtcaagatgtaaacactaagaccggtgttgtaccaaatccagcagaaggtatcaagaacaagggtgacttaccagacggcacgaagtacacatggaaagacactccagatgtaactactgcaggagacaagccagcaactattgttgtaatctacccagatggttcaaaggatgaagttccagtaaccatccacgtaaccaatccaacaactgatgcagataagtacactccagaaggtcaagatgtaaacactaagaccggtgttgtaccaaatccagcagatggcatcaagaacaagagcgacttaccagacggcactaagtacacatgggagaagaccccagatgtaactaagccaggtgaaagtaccggtgtgatcgtagtaacttacccagatggttcaaaggacgaagtcccagtaaccatccacgtaacgaacccagcaactccaaccgacgcagacaagtacaccccagaaggtcaagatgtgaatactaagactggtgttgtaccaaatccagcagaaggcatcaagaacaagagtgacttaccagatggcactaagtacacatgggagaagactccagatgtaactaagccaggtgaaagtactggtgtgatcgtagtaacttacccagacggttcaaaggacgaagtaactgtgaaggtaattgttaatacaaacaatgtaacaccagaaacacaaccaattcacactactccaggcgttcttccaaactcagcagatgctattaagaacaaggatgaaatgccagcaggtactaagtacacttggaaagaagtaccaaatatcaatacagttggtgaacacactggcgttattacagtaacttacccagatggttcaagcgtagacttgacagttaaggtatatgtcgatgctgtcgcaaaggaaaacaacagcaacaatactgctcaagttattactaagcatgttgcagaaaataatgaaaagaagacttctgcaactccagcacaacaaattaagcattctgaaaaggctactttgccacaaacaggtgctaagtctgaaaatacagctggtatcttaggtttagctattgcagcagtaggtagtttgttcggcttaggcgctggtaagaagcgtagagataagtaaatattgtaaagtttgattctaaatatagacaaagaaagaagagactagacgcctcttcttttttgttgcataaaaataagtatttttacgcaaattgcaataataaattgaacacttttagttaagctgcttgatagattagatctaattctctttcaaagatttcatctggtgtatgataggccagtatctttcttggcaaagaattgcaccaggtttcaatattaatgatgtcttgtaaagaatagttagctattgcttctcccttaggaatgaatctgcgaataagaccattgtgtctttcaactgttcccttatcacaagaagtgtaaggatgggcatagtaaaccagtgtattggatactttttctaggttggaaagatctgcaaactctgagccattatcagtggtaatggttttaaaaatatcattccaatgttcgctgtattgcctttggagttctttaaaggcctgcatgacactgacagaagtcttgtcaggaatacgaagaattaaaaactcacgactcatacgctcagataaggttagcagtacctcatcatctttgctcttatgtccgagaactaaatcgcattcccaatgaccgaattcattacgtttattgatctctttaggacgttcttcaatgcttctgccaagttttttcttatttttgcgaatacgatgaagcttagtattgcgtttaagcttctctggcaagtcgtaattataaattcctaataagccttgatcaacgtaattataaagagttttggtgcagacaacatcgctgctagcgaattcgccaacagcagtagcacgattactgcacacatcaagcgaccagccatctttaaaaaaatgcttgtggacatagcgcatgaattgagctttcctgagaaagtctgatttgcgcccacaatttttacgatgagctttatatgcatcatgcccttgagtagccttatattttttgactttaccatgatacagttttacagtgccacgcttaacctcatagctgatagtagaaggagaacagttaagttcacgggcaattgcacgcaaagaatagccatctttcaaacgcaattgaataataactcgctcttcaaatgataaatgcttgcctttaacgtgctggttcatggtagaatgtaaagagtccattttgacctccaatagaaagtttttgtggttattaacattctatcaaacaggtccgaatggactttttattttttatcaagtgttcaatttaattttacaatcagcgataagtatttttatttaaatacttattgacacaattatatgtaagcgctattataattattgtaaataagcggattactgatgcgatcaggtctgagctactacaaataaagatgatatacttaaataggtatattctaatttgtggtagcttttttctatataaaggtgattcgtcggatgatatttcttaaaacatttaataatagtgcagccttggttcaggacgaccaaggtcaagaacaagtagttctaggtaaaggcgttggctttggcctaaaaaagggtgataagattgatgagagcaaagttgaaagacgtttcattgctaactctcatcaagatgaggttaaccaagttaaagaaataaacgcttcgaccatcgatttaactaataaggtgatccagatggttgaacctttattgaatgtaaagttcaacgactttcaatacttggccttagctgatcatattgattttgccctttcaagaattgaagataatattgatattagtgctgccaatacacgttgggaagttaagaatctttttcctaaggaatataaaattagtgaaaaagttattgctttaattaataaagaaatgaaggttaacttgccagtaagtgaaagcatttttatgacttatcattttgttaatgcggcatctgataatgatcaagtgcaagaaacagttgaaataactgaattaataagtggaattattgatattattcaataccaatatcaaatgacattagatacagagtcatttaactatagccgctttattacccacttgagagtattattagtaagacttttaagaaataagcatcataagagctgagaacttgatggttctctattaggatttatgaagattaagtataatcatgcttatgatacggctgaacgaatcgcaacttatttacatagtaaaaaaggatggactttaaactcagacgatgagttctaccttgttttacatatttggcgggtaacgagtcgtcaagaaaaataaatatttcatacttaggtatgttactaattcgattaggcaagaacccaagttactgaaagacactgaacagttatgttctttagtttttgagtagcttgggttttattattgggaggaaagagctatggctaagaattacgatggtctagcaaaaacaattattaaagacgttggcagaaaagacaacgtgattagtgtagttcactgcacgacccgtttacgtttttagttgaaagatgagaaaaaggcaaacgatgatgccttaaaagacacagatggtgtagtaactgttgttaaagcaggtggccaataccaagtggttattggcaacgaagtagctgatgtttatgactctatcttaaaagaaggcggcttttctagcggtggtcaagtagccgatgatgatggtaaaggtacgttagaaagaagaccgaaggattcattctattggtataagaaagttattgaatccaatggaaaagatttagattagttgaattaaaaaaatactgctcgatttttcgggcagtatttttatgaagcgagaaataagctctaaagtgctaaaatataactagcaattaaagtatgttgagcaggcgcgcgacaaaggtaagctcattacttgccaaaagacgtcttgtaggtggtcatagaaccaccttttttgttgcagaattttcttcattaaaatatgtgtgagtaatcactttagagaaaagtaaattcacagattaagtatgttatgatgatttagatcaattttaatttgtgaggaaaagttggatggataaacagtcaaaaagtaggctatggacaattttagctgctttagcagcagtaatgtggggaatctctggattgtttgcagaatctttatttaaagtgagtagtaagattacaccgatttggttaacacaagtccgattaattatctctgggattgttttattaattattgcgacagtcttacaccaaaagccattttcagttttaaaagataagaaaaatactcttcatattattgcttatgggatttttggtttgttaccagtacaagtcttttactttattgcaattgagatggcaaacgcatcaattgcaacgattttacaatttattggaccatttttcgtcttgacatatttggctgtcactcatcaacaagtattaagaaaattggatgtattagctgctatcctagcttttattggcgtattcttgttatcaactcatgggaattttaatcaattagcaattactcctcttgcattgttttttggattgctatctgccgtcggagaggcaagctatacactgattcccgttaaacttgttaaaagagtatcaagtttagtcgtaacgggatggggaatgctatttgcgggaattgggttgatgattgtatatccgcggtttccggcaattccaaatacccctagagcatggctggacgtaagtgcaataattattatcggaacgattattccatttcaaattatggctaatgctctacgctacgtaaaaccatcgactgtaagtttactagatgcctttgaaccattatcagctacagtgggttcagttttgattttcggtttagtgatgtccgggatggattggctgggaaccctcttagttattggggcggttttggctttaaattttactcctaaaagaaatattaaaaaatcttaattaagaaaaaatatatgaaaaaactgctatgctttctgctttaaaaaggaaaatatagcagtttttatttgcttgaatttattttagtagtgtctagccttgatagactacataaagtatatattttattgcaattttaattaaagcaaaaaatatcaaaaaatattttaattttatattgttttttttcattttaatatcatataatcaaaaacaagaaatttaagtcatctcataaagggggagaaattatgaaaaaagttaagtggttaggagcaattacagtattgtccggtgcggcattaactttaactgcttgtgggaataacaacaacaataatgcaagcgataagaaagttagttttaaggaggcagttcctaagaaacaagttaaaaaaggtggaacattaaagtacgcaattgaaagtgactcacctttcacaggtattttcttaccagaattatctgatactgctactgatagtgaaattcaagcaccaggtttagaaggtttatttacaactgatgacagctataagatcaacaataagggtgcagctacctttaagttagataagaacgctaagacaattactatcgaagttaaagatggcgttaagtggtcagacggtaagcaagtaactgctaaggatcttgaatatgcttacgaaattgttggtaatcctaagaccaagacttcaagatatacggattctttagctaacctagttggtttagaagaataccacaagggaaagagcgacaagatttccggtattgaaatgccaaatggtgaagatggtcgaaaagttgtacttcattttaaggaaatgaaaccaggtatgcttcaatctggtaatggttacttccttgaaagtgcagaaccataccactacttgaaagacgttccatttgataaacttttatcagatgataaggttcgtaaacaaccacttttctttggtccatacaaggttcaaaaagttgttcgtggtcaatcagttacttatgtaccaaatgaacattactggcgtggtaagccaaacttagacaaggttactatggaagtaatcggaactaactctgtttctcaagctattaagagtcataagtttgatgttactggtgtgcttaacactcaatggaacaatgttaaggatactaagggcgttaacttcattggtaagattcctctatcttacaactacttaggctttaaagtaggtaagtttgacaagaagactggcaagaacgttgaggataagaacgctaagatgaacaatgtctcattacgtaaggcaatggcttacgcaatgaacattgacgctgttgccaagcgttacggcaatggtttgtcatttagaattaacacattaattccagcacaatttggcgacttttctgataagagtatcaagggatacccatacaacttgaagaaggctaatgaattgttagacaaggctggatacaagaagcgtaagggtgaaaaataccgtcgtcaaccaaatggtaagaagttaactattaacgttgctgttcgtaatacacaaccaaacgctgaaaagatctggactaactacctccaacaatggcaaaagatcggcttagatgctagatttgttggtggtcgtccaatggaattcaactcttgggtacaagatgttcaagcagatagtcctaagattgatgtctttgaaggtggttggagtttatcatctgaaccatcaccaatggacctttacagtgaaggtgctccatacaacatggctcgttttgtttctccaactcaatctaaacttcttactaacattgattcaactaaggccttcaaccacaagtaccgtgtacaagcatttgataagtggcaagaatggatgtatgacaatgcctatgttgtacctaccacaaacagttggtcagtaactgcagttaacaacaaggtaactggctggtcacttaagccatctgcaaattcatggtacgatgttggctttactaagtaattaaaataaattttcctataatcctcatatatcaacaaaaattaaattcttaaataatatttcattaaataaaattttcatagttatattccttcagaagactctacttttgccaagtagggtcttctttttgtatcaacaatgacagcgattacaagcacaaaacaatagaattgaactataccaatgttgaataattagctataaacactactatatttagctttaatttatataccaattaggataaaatataaacattgtgaattctggaggaattaaatgtggataactttttaatagttagtcatggtgaatacgctaaggcaactctagctagctgtgaaatgattgcaggaaaattatcaaatgtaaaagcgattgcttttaaacaaacaatgaatcaagatgatttactttatgagattgctcaaactgccgaaggttttgaacaagtgccaactattattgtggatattgccggaggaactcctgctaacgctgcattacgctatcagcaagaacatcctgaagtaaaagtatacagcggtctgtgtttgccacttttgctagcagcagtaatgggaactccgatggaggaagcaatcaaacaagctaaagaaaatatagcgcctgttggaaagccaactgaagataaggccacctcaaacaagaaagagtctcatcaaagtaacgaattaaataaaaatgcggaagtagaaccacaaactatgcacaacgttcgaattgatgaacgacttatccacggacaagttgcgacgatgtggacaaatgcattgcgattaacgcgaattatggtagttggagatgatatcgtaaaaaatgatattcaaaaaacagccttaaagaccgcatgtccgcatcgcgttcacttaagtattttgactgctaaaggtgcagccagaagaattaatgaaggaaaatataaaggccaaaccgttttagtgttagttaaaaatcctggtgttttacgtcaaatggttgataatggggtgaatttacctgaaattaacgtaggaaatatgtctactaaggctgattcacgtcaagttgcgaagagtgtggctgttactgcagaagatgtggataattttaactacttaaatgagcatggttgtcatctttatcatcaaatggtgccggcagaagacaaagaagaatttatggagttattagaaaagtaaagggaagataagacaatgacaatacaatggtggcagattttattactaacttgcctagcattttgggcaattattgatcaattaactgtatcaattgtgaataatcctttagcaattgggatgatttcaggaattattatgggtgatattacaactgggctagcagttggggcaacgctccaattaatggtcttaggggtctcaacatatggaggagcctcaatgccggactttatgactggtgcaattgttggtacagtttacgccgttatttcaggaaaaggtgtgcagtttgcaattggtttggccgttccagtaggactcttaatggtccaactagatgttttagccagatttgctaatactatttttcaacatcgaattgatacttttattaaagaaaataagccaaatgcggcagcaagaaatgcattgtggggaacatttacctggggattttcacgtgcaatcccagtttttatcttacttgtagtaggaaatgatgttgttaaagcaattctacgaataattccagcttggttgactgatgggttaaaagtatcggggcatattttgccaattgttggtattgcaattttacttagatacttaccaactaaaagatttatttcttatttagcaataggcttcattgcagcggcttacttaaaaatgccaatgctaggggtagcgttgctgggagccgctttagcttatctccactacactcgtgaagtagaaaaattaaatacaaaacaaaatagttcagaaaaagtaactgagagcgaagaatatacaaatgaagagggagaatatgaaaactaattcaaataaattaacaaaaaaagaccttttccgagcaaattggcgttggctctgggctagtcaattatcttggaactatgaaaaaatgatggctcccggttacttttacactgttttgccatttttaaagcgctggtacaaagatgaagaattagttgaaatgatgcagatgcagtcccaattcttcaacgtgaatgcatttgatggaaactttatcattggaatggatctggcaattgaagaaaagcagggaagtaaagctaaagaaacaatcgccggcttaaagacaggtttaatgggacccttagctggagtaggagacacaatttttggcgctattattcctacaatctgtggatcaattggtgcatatatgggattacgaggaaatccttttggagctttcttgtggataattgttaatttgattgttttattcacaagatttggctttttaaacctcggttattcacagggagcaaaattaattgattctgcttcaggtaagttaaatgcaattaccgactctgctattttacttggggttaccgtcgttggggctttgataccaacagtagtgaatgttaaagtaccatttgtatatcgagcaggcaaagtaacattaaagatgcaaacaattctaaatcaaattatgccatccttagtacctgtcttacttgtagctttagtttactggttgctaggaaagaaacatgtgacatccactaagatgatctggtttgttttgattttaggaattgttttaagttacttccatatcttaagtgcctaaaaaatcgtcttagtatttttaatactgaaatgaaggctattgttctataattaaaagtaacaataaagatttataaaggaacttttatgaaagaaaaagaaaagaacaccattgtaggacaattgcttactttagatttatttgcaattatttgtggctattattttattgatacgataaatatgtttgttaagcagcaagattggtggtatgacctactggtagtgttaattgtaatctgtgagatggtctacaattggcttcagctgctaaagtataagaaaaaaataccaaatttaatagttatcttaactagtgttaccgtaagtgcaattctgagtggaatatactttagtgtgatttgggttaatattcaaaataaacaaaattatcaaaacaatatagttctagcattaatctgggtatgtatgctagtgattggcaatatagttttgtggaatagatataagaaaaataattaaaaaatgcattattactagtttgaaattagtaataatgcatttttatatttattcagaaaaattattctacaacatgtctctcaaatggatcgtcggaaatacctttttctaaaatatctcttgaccattgcttagctgagaaaagagagtggtcgcggtaattaccacaggattcgatcgtagttcctggaacatcttcccaggtaatattatcgcgaatttcctcaagtgattctttaagtgccttagctacatcggtagttgatggagtaccccaaactaagaggtggaagccggtacggcaaccaaatggtgaacaatcaatataaccatcaatgcggtcacgtaataatccagctaataagtgttcaatggtatgcaagcctccagtaggaattgcattttcattaggctgaaccaaacgaagatcaaaattactaattttatcgcctttttgtccttcttcaacagtaattaaacgaacgtaaggtgccttaactttagtatgatctaattcaaaactttcaactttacccataatatttccctccgttaaaaacttttccaaatattatttgctatcttaacaacaaatttaatctttttccattgatcagcttcacttaaaatgtttccttcttcagtagaagcaaaaccgcattgggtacttagagccagattatttaaagggaccaattgggttgcttccttgattcgagttgtaattgtatcaggattttctagctgtccattttttgaagtaatcaagccgagaacgatggtgacattatcacgattattccaaatttgcttaattggtttcaaatcaccagcacgatcactgtcatattctaagaaaaagcggtcatagtttaactgactaagatattttgcaattggttcatatccaccagaaaaaagaaaagtagacttgaaattaccacgacaaatatgtgttgcgactgttagatcatcggggagcttttctagtgatttattaattacataaaccgaatcttctgctatttgaacgtatttttcatgttctttgggatcattttgcgtttcatttaatttactgatcaaaaaagcccaagtagtatcatcaatttgaatatagcgacaacctaaatcataaaaatgttggattgttttattgtaggctgtagctaggtcgtctaagtaatcttttttattatcgtagaagttaggccaattgtcagagcgattgtccctaaataggagagtaggggaaggaatagtttgcttagcaactgcattttttacattagccttaacaaatttaaatgcatcaaaaaatggatggtcaggattataggcaatttttccagatagctctgcattatcggtcctagttttagcaccgtggaacttatagctttctttgtaatcatatttggcaacgccatttaatccccacaagaaatccagatgccaccaactacgacgaaattcaccatctgtgactgctgttaatcctaattcttcttctttttgaattaatcttttaatttcttgatcttcaattttagttaactcttcttgtgagatcttttcctggctgaaattctttcttgcttcttttaattcttctggtcttaaaaaactaccaacaatatcgtaatgggttaaagttgtcattatagctacctcatcttctaactagaaattttaaatattaatttgaagatccgctgacaagagggatcatgaaataaaaaccacacattcgataaaatacctgttcactaaaatattcttttttgatattcaaaataatccctcctttgaatttaataaactaattaagcaaaagaaaaagcgccccaagtatagtttttaaactacactagggacgcttaatagcgtgttaccaccctgcattcaaattaatcttacaattaattcctcactgagtactccaaaatttggaagactcggacatgataacgaacgtcaatcgtaaactgcttacttaaattagcttgcactttaatttagctccaagaccatcttcattacgtcagcaacatcggcttgcacctaatccgactctctgggggatgctttaagtaattactcatcttttctaagctttaattaattttgttgtcataatattacaacgcttaaaaaataatgtcaataaaaatttttagctaagttattcaacttcagcatctacatcagatttttcattattaaaagtattccagtttagttctccggttcgcttagcagtaataacaccagcaaccattgaatcattaacgttaagagcagttctggccatatcaacaactgggtcaatggcaattaaaacacctaaaactgttactggtaggttaagagcacctaagaccattagagtagtaaaggtagcaccgccaccaacaccggcaacgccgaagctagaaataacgtcaattacaactaaacttaaaacaaattgccatgagaaaatgttaactccaacaagtggggcagtgattgctgctaccattgatggataaatacctgcacatccattttgaccaatggttaaaccaaagctagcagcaaagtcggcaatggtatcacttactcccattgattcacgttgagtacgtacattaagtggcaaactaccaccactagttctagaagtgaaagcaaagactaagacgggccatgctttcttgaagtaggtaattggattaattccgttaattaaaagtagaactgcatgaacaatgaacataacagcaatcgcaaggtaagctgcaacaataaagattagtagtttactcattgtgacaaaactgttagttgcagtagttctagcaatcaaagcaaaaattccgtaaggagtgagttcaagtacaatcttaactatgcgcatgataaccgcacgtagggcttgaataccacgtgcaaatgtagcagcaacgtctgctctttccttcttaatctgtaagaatgcaattccgacaaaaatagagaagatgacgattgcaattgtgctagttgaacgcattccagcaaaatctgcaaaaatattttgcgggaagaaggatgttatttgttgaggaagggtcaagccttttaattgagcctggtgatctttaatagaggtaagagcagtggaggaagcagatattcctttagcaaagccagccccacctaaattaaaaatagcgacactactgaagcctaagaaggaagcaacagctgtagttcctaataaaatagctaaaacactggtagcaatttttctaatcttagtagtcatttttagttgagtgaaggctccaactaaagacacaaagattagaggaattactagcatttgtagtaaggaaacatagccatccccaacaatggaaatccagtcgatactattttttacaatgttactgttagcaccgaacattaattgaagggaaacaccaaagatgattccgacgataagggagaggaatactaatttagtaaatccccaattctttttatgtaagtaagccataccagctagaatcgcgatggccattaaaacaacgagagtagtttgcactttattcaactccaattctaagcaaacaaaagagagccattggcctaatgccagcagctcttgagaaaaaccatagttataactttgaaaagctagtttctaactagagaaattcttgaatgaactaatgactgtacgccaaataattgccaaatttttttgacaattacaacaacaagaatttgcttgacgtacattaaacataatcattagctcctttcttacttttcacaagctatattatcgtacaacttacttttagtcaacacttaatttaaaaaataatctatattccataaatatatattatgccaactttatatgtaaaatactgtatataagcattgcaagccttttcgttagtgggtataatcaggttgaagagatgtagatttatgaggtgaaataaaatggcagaacctaaatggctacaagatttaaaagaagaagattatattaaagaagactttgatgcgaccggcaaatcccgatacacggtcgaaggtatcgataaaaatgatccagattggttgaataaggctgctaaaaaggtacatgcagcagaaggcgacgactatgtaaaattggatgctggtcttcttaccgttaaccaaattaattggatgttacgtcgtgcgtttggtgaattaacttatgtagatgataataaccaattcttgtggtataacagaccaactgatccaaataagaaaatgctcgccaaacgtacgccagatcaagttggtgatacaatgggcgccgttcacccagatattcgcaatgtaattcctgaagctaagaaagttatttatgctttaagaaacaaaatagatggtcatgatgaggtaaaaatgccagttcctaatggcaatcgtcataaattaattttgcatgattataagcgaattgaagatgacgaaggaaattacgtgggaacttatgaatgggtacaagatatttatccatttgtgaagtacttctgtgaaactactggtcaaaagctagtagatgatccggatgctacaacgggtgcaacttataagagggatgaagttgatactggaactggtgcatctaagcatgaagagcatgtggaaaagaagcaagaagaaactgatacaagttctggtgcttcagagtattaattaaaattatagataaaaaatgacagatattaatatctgtcattttttgcttaaatagtttctaaataccaatagtgacacaaaaaactaatagtttatttttttaagttagatacgaatatattaataatgcgaaatatcttatcaatggtacagaccattaatttggaaaaattattaataaaagcttcctaccccattaattctagtaaaaagctaaaactaagaaaatgaaatatatttcagagtttgacaagatgtttgaaacatctgaaataaaattcttaacctttgaaaacgctttcttaaataaaaatttagcggtataaataatgtgtaagctagctgagaggaaaaacaaggaaaagtttttcaagatatatctgaaagagaatcacaaaaagggagtagaaactgtatgactaaagataatcgtaagttttcagttgttattgctggtggcggtagtacctttacaccaggatttgtactgaacttattacaaaatcaagatagatttccattaagaaagttaaagttctacgataacgatgcagaacgccaaaagaaaattggggatgcagtagccattattatgaaggaaagagctccagagattgagttcgaatatactactgatcctaaagaggcatttaccgatgtagattttgttatgggatcaattcgtgtcggtaaatatcacatgcgtagcttagatgaaaagattcctctaagatatggggttaatggtcaagaaactacaggacccggaggaatggcatacggtcttcgttctattccagccattattcaaattattgattggatggaggaatattcacctaatgcttggatgattaactactcaaatacaattgcaatcgttgctgaagcttgtcgtcgtcttcgcccacatgcaaaagttattaatatttgtgatatgccaattgatatcatgacaagaatggctcaaatttgtggattgaaagattatcacgacttagatttcaattactacggcttaaatcactttggctggtggaaaggtgtttgggacaagaaaactggtaaagatttaatgccagaacttaagaaatatgtttcaaagaatggttactgggtaggtggcgattttgataaagatactgaacctagttgggaagcaacttttaagaaggcagctgattgctacgctttggaaccaaatactttaccaaatacttacatgcagtattattactatccacaatacgaagttaagaatgccgatccgcatcatactcgtactgatgaaattcgtgaatatcgtcaaaagattgtctttggtgaatgtgagcgaattgttaaggaaggtactgcagaaaataatatgtgggatcgtaatgcgactcactcagaatacattgtcgatatttgtcatgcgattgcctataacactggtgaaaagttcttagccaacatccctaataatggtgctatttcaaatatggatcctgattcaattgttgaagttccatgcttatttacttcacatggtgttgaaccgatggcaactggtaaggccggaattttccaaagaggattgatgatggaacaacaaacctgtgaaaaattggttgttgatgcatatgaacaacactcttatgaaaagatgtgggaagcatttgcacttaataagactgttccagatgcacttgttgctaagaagatacttgatgatatgattccagaaaacaagccttactggccagaactaaaatagaaacttaatagataggaatttattaaaggaggacttgttaatctggtagtttaataagtccttcttcttgtgaggtgaatgaattatgatgcagaaactacaaagatttggggcggctatgttcgtacctgtcttgcttttctcatttgccggtattgtggtggctttaggaagtctatttaataatgcaacactttttggctccttagctaatcctacaactgggtggtataaagtatgggacactatttctgccggtggttggacagtttttaatcaagaatgtttgctttttgtggttggattacctattggtttagctaacaaatcaagaggtcgtgccgcaatggaagccctcattacttacttaacttttaactatttcgttggagctatgttgagtcactggggtgcgttctttggtgtaccaaactttaataagattcaaattactgctaatgctactaatggtggtttaactgaaattgctggtatcaagactttagatactaacattgttttctctttaattattgctggtattgttgtttatttacataatcattactttgataaaaaattgccagaatggcttggaactttccaggggtcaacgtatgtttacttcttaggattctttgtaatgattccagttgcatttttaacttgtttaatttggcctaaagtacaattaggtattaacagtatgcaacaatttattgtaagtagtggatttgttggtatttggatttactcatttttgaaccgtgtcttaattcctactggccttcatcacttggtatatattccgttccaatttggaccagctgttgttgctggaggtcttcaaccatattggctaaagcacttgactgaatatgctgcaagtacaaaacctttatcacagattgcttctgtagaaggattccaactttacggtaatgaaaaagttttcttagtaccatttatttgttgggcattctatgcaactgccaagaaaaataaaaagaaacagacttcagcattacttataccagcagccttaacttctgtttttgctggtatcactgaaccaattgactttacttatttattcgcagctccagtactttggattgtatattcagttatggctgctactatgaatacggttatgtggtgtttcggtttaagaggacttatgtcagatggtgcaattggtattgcttcaatgaattggcttccactttgggcacatcactggcacatttatgtaatgcaattcattgttgggattgtatttggttttattacttactttatttttaagataatgattgaaaaatttaactatgtaactccaggacgtgaagctgatgatgaagatgttaaattaatcaataagaaagaatataaagaaaagatggctcaacaaaaagctgctcaacaagcaacaggtgttgatgctaatgatccttatattgctagagctcaggcttacttagatctattaggtggtccaaataacattgaagaactatcatcttgtgctacacgtttacgtgtaacggttaaagatccagaaaaattaggttctgatgcacaatttaaggctaataaagctgttaatgtggttcaccatggaaaagctattcaagttattgttggtcttgatgttgctcaagttttggaaagaatgcagagcttgatggaaaatgctggtcatgatgccaaagtaagtcaagaacaagatccagaggtcgaacaagcaattggtttcattgacttactaggtggacgtgacaatattaagaagttaacgccttgctcaactagaattagagttgaagtatatgatccttctaaagtggctgatagcaaacaattcaaagatcttggagcacatgatattactcataaagataacgaaattgatattgttattggcttaaatgcagagaatattattgataagatgaaggaaaatatgtagtatttccatgcgctgataagcttattattatgttatgctactagtataattacataacgcttacattagtagagggatgaacataataatggctaacttgaaacgacgtgtctgggaaaaaagtggcgagttaagtgaatctgaaaaagaaattattagatttttgttttcaaatcccaccttatgcagtcatttaagtttatcaaaattggctcaaaaactatatgtatcagaatcatcaatttttagattatgtaaaaaaattggtttatctggatatagtgaattacgatttgaattatcggatttaagtcatgaaaagaaaatgaatactattgatattgcaactgaagtagagaatgcaaatcaagaggtgctaaagtactataacacattagatttagaaaagattttttctgatattgaaggtgcgaatacaatttatttatattcaactggatggtctcaagaactaatagcaaaatatttagctcatgaattatttatgattgggaaaagagctgtaattctgccatctgcaattgaagaattaagaattgtaagtcggcgagctgtaacaggagatatgttgtttataatttcttatagcggagataacattcaaattcgcgatgaaatcagtaagataaagctcctaaataacaaaataacgatggtatcatttactactttaaaaccaacacagttggtatcgctagtagattatagtttcttctttcgtaccttgaaattccaaaaagttctgggaggagaagagtctgctaatgacacctttagtccagcctataccttcattgatcttttaattgctaactactgtcagtgggagatgcaaaagagaggaatagactatgtggactacgacgaagaataaagtagctgatttttgtgatcagattatggaacgtttgcacttaaatactcgttctattttaaaatggtactcaattattttatttgttgctccactactttattgggctcttcttgagtttagaatagtgatggaaaaagcaagtttagcagatatgatgcacaatcagccagcagtagcgatttccgtaattgttgctattactgattttctcttagggtattattgctggataaataaaaataaattagttaacaatataaaagcgttaaagactttttatatttggcagttcttttgtcaattatttgtgggtaatattatctgttcattattatgtcttttcggactacgcgctttacaaggtcaaaaaaataataatgttactgtgtcatattttaaggctactattcttgtcagcactattttgtatattttttgcatccttttgctagggttgattggattaaaagggttaagaggttagaaaaatgtttgatttttttaagaagaaaaataaaggactagaagtagaggccgctgttgatggtgaactaatacctattactgatgtaaaagatgatgttttttctactaaaatgttaggtgatggttacgctattaagcctactagtggagaagttcattcacctgtggaaggtgatatatccactttattccctactaaacatgcaattgggattaaaaccaaagaagggttagagattctagtacacttaggtattgataccgttgaattagaaggagcaccttttgaaatgagaattcaaaaaggtgaccatgtgacagctggtcaaatacttggaactatggatttaaaacagattactgatagtggccgtgatgattcagtaattgttgtttatactaatatggacttaattgattcaatctcccccgttcaaaaaggatctattaagtcgggtgataaagtacaaacaattaattttaagaaaaattaggtctatcttgatataaaagcacctgtgacttcaattgataaacaagaagccatgggtgctttttcttatacatttaaatgataaaaaatattgagttacttatttttttcttgcaataaatcacgaatttggcgaaggtatatttcttcgttagttggtgcaggatcttcttcaacttcttttttaggtgtaattttattaactaacttaattaagaagaagacaactagagcaataattaagaagttaataacagcatttaagaagctaccgtatttaaatgtagcttcaccaatagtgaattttaagttggaaaggtcaatttttccaataaataatccaattagaggattaattaaatctttgactaaagaatttacaattgctgtaaaagcagccccgataataaccccgacagctaaatccatcatgttaccccgagaaataaattctttgaattctttaaccatggttgatctcctttcaaaaaatacttacttaattaaaaattatatcgaaagtagaaatgataacgctagaaaaatgcctatagaaaaaacgttagaaattaatctaacgttttttaagataattaattatgcttttttctgttaactttatcgctaataagtccaagcagagaggctgcggtagcaagggctaaaccgagaatgcctatatccgttgtttttgtaccagtttgaggtaaaatctttttcttttgaactgatatattattagtgttttgacggctcactttagaattctgataagattgatgagttagttgagtaagtttatcagatgatttatggagtgaagtcgagatagtaagtttagtaggttgaacaggcttagtaggttcgaccggtttagtagtttgcactggtttagtaggctcgaccggtttggtaggttcaattggtttagtaggttgaacaggcttagtaggctcgaccggtttagtaggtttgaccggtttagtaggctcgaccggcttagtaggccgaacaggcttagtaggttcaaccggtttagtaggctcgactggtttggtaggttgaacaggcttggtaggctgaacaggcttaataggctgcactggtttagtaggttcaaccggtttggtaggttttaccggtttagtaggctgaacaggcttagtaggtttcaccggcttaataggttcaaccggtttagtaggctgaacaggcttagtaggtttcaccggcttaataggttcaaccggtttagtaggctgaacaggcttagtaggtttcaccggcttaataggttcaaccggtttggtaggtttcaccggcttagtaggtttaaccggtttagtaggctcgaccggtttggtaggtttcaccggcttagtaggttcaattggtttagtaggttgaaccggtttggtaggttgaacgggtttggtaggctcgaccggcttagtaggttgaacaggcttggtaggctcgaccggcttggtaggttgaacgggtttagtaggttgcacaggcttggtaggctcgaccggtttggtaggttgcacaggcttggtaggctgaacaggcttagtaggttgcatcggcttgataggctgcaccggcttagtaggtttcaccggctcagcagtatagactacgttaaatactaaatccttactatttggagtaataaattgttggtcaatttgtttgtgatcggtagtataaccattaataataggtgatttaacagcagaaaaactacttatacttggtgtccaatcttttatttttctaatgttagttactaaatctacttctccagattgaacaaattgaatcgaattagtgtagctaggggctgcttctgtaccattatcataaatatagttaattgtttccttaatacttttcgaattatttatttcttcaaattgatgtttaaaatgaaccacgtaagtttgatcgtctggatcttctgtgttatcgaatgaaagtgtttgttggttagttggatcggatactagtaaatagttcttagccagatacttagttattgtattcttagtagaatattgagaactagtatcaggttggccggataacacttggcgctctaaaatttcattagttgtatcatccttataaattacagttatattttcggtaagaacataaggtacctttattaagaattcaaagttatttggaagagtaataattaaagcttgatcttgttttttatcgaattcgataggtgaaatttcatgaccattaagttcaaactttttaagtgttgaagaaggctgtgaaatattttgtgaattgagcttataaacattgaaaattatttcagaaatggaaatattttgtgctttattttcaacattccaagcatcccacgtaatttgctgattaactaagtctttttgaccagttctaataaagttaatatttcctaaattcaaggtcttaaaaatattatcttttcgtgggccattttctgcatatagaattgctttttccgaaatagatttattttcattaactggactgatcttatgagtaaagtgagcaataaaatattgattcgttgtattatctgtatcaaacttgccataagttacatcatttaatgtagtccccgataaactatcagtagtttgagtagggttatcacctttgttgacagcaacgaagttataatttgaaaagtcataacttttcggaatagtgaataaaatagggctgctgcttgatccagtcacaattaaatctttagcaaaatcaataaatttcttactactatcatcataaaatctaagtgtagcttgttgtttattagcagtataaatgacagttttatctatatcattagacgtatgatcaacgctaattggagcaattttactttgagttggagtatagccagaaattactggtgatactacttcaggaaatgtttggacggcagaccatttactgttttccttaccagttaccaaatctttagtaccagtttttgtaaaggtaactgaatgttttacgtcattagcagcttgtgaattatcttcatacagataatgaattgtttctgttacttctttagtatctgaaatcggctcagtctcatgtttgaaatgaagcacaaagttttgatcttgggtttcatcgtcatcaaaatttccataggaaatttttgaatagtcactactactagttgatccgattccactaactccactgaatacatagtgcttactatttaaaaagtcaataactttatctacacctgcaaatgaaattgcttgtttagttgaattattatctgctttatcataaatatcatttattacagctgtttgattgttttgaagtaagtatgctgttaagtcttgtttgtcagtgtcatcgtagaagtggagagtggccttttcgggagcgtagtagttaacagtataagatagtggaatgctattttgagtagtaatttctccattttcactaatattggtctcaattgctggaactactagaggatcaattagactataggcggaatcagaagcaattggtgaattaactgcgttaaaggtagaatcaggcatccaactattccagtctatgtaattagtaacaagatcttcgataccattacgagtataagtaactgtatgagtatatggtaaagcagctagttcgccctttttcgttccattagcacaaacataattaatagtttcagttactgaactagtttgagattgaggttttgtttcatgataaagataaacgtaatactttggtgaagtatttttaacgttgatttcttcactgttgtagctattgttcaaactatcaagcttaaagttttgagtagcaatgttatagttagttaaattttcactatggctaccattttttccttcagttgcttcttgatctaaaacataatgtctttcttcaagatctttaataatgtccattgtaggattaggaactgaactattagttgcagtaattatatttttagcgctgtttggaatttcttgattagtgttttcatcaataaaacgaattttaataattctgtctactgtcggatctagtttaaagttagtataggtttgcgtaaaagtattagcagtactaccagaaccagatgggttccagtcgttttcatttgtagtcggagtactaatagatggaccggagctaggagtgttaatccaatcaggaatcttatttatatcaagttgagtatctagctgaataaagtaaggcccatttttagaataatcttcaccattaacagtaaagttacccttttggtcaataactatttctctgccatcattagaaatagaatttcttaaaaagttttcaaagttagtatcttctgaaagcgtagagatttttgaataataatcattaatactgattctttgtccatcagaagcaactacttttatattggaaggaattttgaataccttaatagtcgatggaagaattctttgaccgctactaaatttaatatgagcaagaacattaagcagtggttttaaacttggattggtagatgacccgtagttccaatcaatggcatattgcattagacgagcatctttttgttgggcaaccggaatgtcagcttttgcactaggttctggaccagtatagttagcaccatattctgtataaactccgtttgcgcctggattgccgtcttctccgggcgtccagataacttttggaccaattataaaaccatggagaatctcttcattgataactttatcttcataaggattaattttaattggaagattttgggtaaatgattgtttattaggcaaagtaactgtaacaggaagagttaaatcggggtaagtaccatatttttcatagtattgggtagtagcagtagtatcggcattaaatggaaaagttgcatcaaaaccggataagatgccgtcatcacttcctgtgtaagtaaaagtgaattctttattagcagctgtatcagttctattcatatcaaattcactagttttagttggatttacattaaagctcaacagattatttttatcgttaattgaaacgttaacttgttcaccatgattaatagtgagtggtgtagtcgcatgattattgatatgcacattaatggcaccttgagttacgccagcgataagagaatcattagttttagctccagtaatgcttactgtggattcattctgatttgtttcttcattaagattgttagtttgattagttgggacagtcacttcatttttagaagtgagagatgattgtgttgaagaattattatcttttgtacttggatcgctactatgtgaattgttttcagcactagtttcttgtttctgagtcgtttcgactgaattatttgaagttagttccttgctaatattctggttactatcagtattattttgatctgctgcttgaacagtattagaacttgctaaaaagaaagttgtacctaaagcaacagtaactaatccaactgaaagttttctaaaactaaacgtttccttcccattaagtttagtaataaaaaataaatcatttttacgctgattgtaaaattaaattgaacacttgataaaaaataaaaagtccattcggacctgtttgatagaatgttaataaccacaaaaactttctattggaggtcaaaatggactctttacattctaccatgaaccagcacgttaaaggcaagcatttatcatttgaagagcgagttattattcaattgcgtttgaaagatggctattctttgcgtgcaattgcccgtgaacttaactgttctccttctactatcagctatgaggttaagcgtggcactgtaaaactgtatcatggtaaagtcaaaaaatataaggctactcaagggcatgatgcatataaagctcatcgtaaaaattgtgggcgcaaatcagactttctcaggaaagctcaattcatgcgctatgtccacaagcatttttttaaagatggctggtcgcttgatgtgtgcagtaatcgtgctactgctgttggcgaattcgctagcagcgatgttgtctgcaccaaaactctttataattacgttgatcaaggcttattaggaatttataattacgacttgccagagaagcttaaacgcaatactaagcttcatcgtattcgcaaaaataagaaaaaacttggcagaagcattgaagaacgtcctaaagagatcaataaacgtaatgaattcggtcattgggaatgcgatttagttctcggacataagagcaaagatgatgaggtactgctaaccttatctgagcgtatgagtcgtgagtttttaattcttcgtattcctgacaagacttctgtcagtgtcatgcaggcctttaaagaactccaaaggcaatacagcgaacattggaatgatatttttaaaaccattaccactgataatggctcagagtttgcagatctttccaacctagaaaaagtatccaatacactggtttactatgcccatccttacacttcttgtgataagggaacagttgaaagacacaatggtcttattcgcagattcattcctaagggagaagcaatagctaactattctttacaagacatcattaatattgaaacctggtgcaattctttgccaagaaagatactggcctatcatacaccagatgaaatctttgaaagagaattagatctaatctatcaagcagcttaactaaaagtgttcaatttattattgcaatttgcgtaaatcatttttatgttccattttattctttcctcggttatggatgttttttaataaaataacattttagctttctaaaagaatattatactccatatttaaataatggattattagataaggaaaatagtctggtgctagtcgggggaaaagacaagctaaaggtaaaaaaacgacttaaaaaagtaaacataaagataaaaaatacgtggtttattgaattgtaagagtagaaaaatatataaaaatttaagtgaagatgattactaagataaagaaagcgctatctaaaatttaaatgacacttacccgcatatttaacgaaaattgtaaactcttgttttcaatttattaactactatactagatacagatgcttttttgagaaaaatgcggataaggcacaatatattgtgtgacctaatataaagaaagaggagttaatacatggacaattccacatcattacaggaagatcgtaaagaaagaaaggataactacttcgtttggctctttaagcaattacacggttggccagttcaaaattatatgctttggttctttgcttttggcttccaattagctattttgattcaaaataagattactactttaacagtaattacttttattggtacattgcttggtactttatgtgttttagctattaatgcaactaaagcaattaatggatggttaggcttgatttccgcagcttgttttatttatgcaggactagctgctaagaattatctttcaatttttgaacaaattgcttatattttaactttagatttaccagttattatttcagttagatcttggaatgacgatactaagaatcacttacgtaagtttggtgctaaagaatggattgttgccattgttggtacattagttgtttatgcagtatctggctatttaattggtaagtttactaacgatccacgtccttggatcgatgctattagctttgcaatttcattaactgctggcattatgtgttttttacgctacaataaccaatatttctggtggactgctagtggaattttccaattaattctttggggtgtgacttatgcacagggagatgcaactttagcaatggctgttaactccttaatttacgttgttaatgacgttttagcctttactgtttcaccatggtttaacatgggaagaaagcgtgaagggttaaaagctattaaagactaaatgtaattaaatacgttaaaattagcatgtcgagttcgacatgctttttttatttgtgaggtatcaaaaatgaatgaaaattggactaaaaattataaaaaagctgcacaaggtaatgactatgtaaagttaaatgcgggactaatgaaagtaaaagacctcgataattatctttcttcgtttcctagtagtttgcttagttttaataagactggagaatttacatattataaacaattaccagggatgaattataatccgccagaacttggagaaaatattacgtctcttggccaaacagagagtgaaaagaagcaattaacagaagtattccacaagttaagcacaggtgaagcaaaagaattgcattttgcagatcaaactaatactcaaaaaagatttatggtagacacatatcgggctatttttgataaagaccatcattttgctggaattaatgaaactgttcgagatatttatccacttgtggaatactacttaaaagaaaccggacaaaaattggttgatgatgccaataatcctaaaggagatatttatcggaaaaatcagaaaattgatgcagaaagtggagcttcggaactatagtgaattgacagaaaactattttttcttaaaatataattaaaaatagtttggggatggtaaaaatgcctgaaattgatcaaaaatatattcaaaataaatttatagaatactgtaaagtaaatactcgttcagatgaacaaagtacagcggtgccgacgactgccggtcaagttgacttgttgaaaattattgagaaagaattagaaaaattaggcttagaaaatatttcattttcagaagaagattcctatttagtaggaaaactaaaaaagacaactaagaaagaagtgactccaattggttttgtagcacatgtagatacggctgattttaatgcagaaaatgtaaaaccgctagtgcatcagaactatgatggaaaggatattttcttaaaagagggacgtgtcttatccacaagtgaatttcctagtttaaaaaaacatttaggtgaaacattgattaccgctgatggaacgactttacttggtgcagatgataaggcgggaattgctggattactaggaatgctcaaacttttaaaagaaaatccttatcttgaacatggagatatttgggttgcttttggcccagatgaagaaattggtaagggtgctgctcgttttaacgtggaacgttttcctgttgaatttgcttatacattagataatggtgatccaggagatattgcatttgagaccttcaatgcagcagcggctacgattgattttcatgggacagtagttcatcctggcgaggcatacggtcttatggtcaatgcagccttgatagctagtgaatttattcaagctttaccaggaagtgaggtccctgaaaatagtaaagattttgatggctattttatggttttatccaataacggcaatgtcgattatgcaaaaattcaattaatcattcgagattttgatactgatggttttgagcaaaagaaaaagttaatcacaggtacagtggataagttgaataaaaagtatgggacaaatcgagtaacttttgaaatgcatgatcaatatcatagtccaggagatttgattaaagagcatccctatgtagtaaatctagttttacatgcctataagtctcttggattagagccaaaagttatcccatttcgaggaggaacagatggcgattttatttcagaaaagggtattcctacacctaacttatttaatggtggggcaaatttccatggaccatatgaatatgtaacaactgaaagcatggctcttttagctaaaaccttgattgaaattgcgaagcagcatgttttattaaatgataaacgtgatgaaagtccattaaagaggaagtattagatttaaatgaatttctatacgataaattatattcaaaaccatcaaaatacagatcgaacagctttatatattttaataattattgctgctagtgcgatgattatttttgcaattctatatttgcgtgatcgttttaataccagatatagggatttaggaatcattgccctcttgtttttattattatttaccggcacgcaatatgaaaaatatgtgcaaaataatgaacagaagtctaaagctgcccaaattgttccctttattaaatcagttgctgatgatgaaaatgttaaagaaagcgatgtgatggtcagttcactgagtttgcaggatgggatgattgtgcgaattgattcgaaaaatgaagactatcaattgaatttaaacgaaaacaataatagctatacattaaatcgagcgcacgtgattgatcatcatgtatatgtgcaaaagtaggtaaaagatggattatacacaattatttattaagttttctctagggatattaaccttgatcattcaaattaatgtttttggaaaaagtaatttagctccaacaacagctttggatcagctgcaaaattatgtactgggcggtattatcggtggtttaatatataatcaaagtattaccgttcttcaatttttattggtgttaatcgtttggactttagtagtttttattttgaaatttgggcgcgagcgcagtaattggattcgtaatttgattgatggaaaaccggttcaagtaattaaaaatggtcatgtgttggtcggaaattgtatgaaagctggtatttctgccaatgaattaatgtttaggcttagaagtagcgggatttattcagttgaaaaagtgaaaaattgtatttttgagcaaaatggtcaattaacgataattgaaaatgatgaagataatattcgttttccgattattagtgatggacaggtaaatgaagacgttttggagttgatccataaatctaatgcttggcttgaacaggaagtaactaaagctggttataatagtactgatgatgtctttttaggagagtatattaatgggcagttacgtctggtgggatattctgaaaaataaaaggaagaaatgatcatgaaagattttgaagagataaaaaaatggttagcagatgccgatgcaattattgtgactgcaggtaatgggtttgcacagatggaaggccttgatatgtttgacaatttgaccttcccgattgaatataagaatataagtgaaaaatatcatgtaaaaacaattgcggatgcactagataaagattttgattcttgggatgaaaagtggcaattctggagtcaattaattaatgagtattcagttgaatatgagccaagtaaagcaatgaagcaattaaaagaacttttaaatggaaagaattattttattgctactagtacttttggccatttttttgaaaaagatggttttgatcaagaaaaaatctttaatatttttggtgactggacaatgatgcagtgctctagtggtttaaatcacggtacacactctgatttgtcaacagtgaagagatatattaatggccaaggagaggttccaaaatgtgaggattgtaattcaccaatggaacttcatatgccgttaaatgctcacttctttccagatgaggatgcaaatactagattccgttggtttttagccagaaatcagactaagaaggttgtagtgcttgaactaggagttgatccaactagtcctcagcttcttgatccaatggtaaaattggttgaacagttcaaagattggcattatgtagcagcagacttaagtcaagatgaattacctgacgctattcaaaaaagaagtgtaggtctagacatggcacttcctgaagcaattgaaaagatttcaaagtaatgaaaggtaaaaaatgagtatttcagttattcaaggtgttttacgaattccagcagctcaagaaaaaatacgtcaaaaaggcatcgaaaagccgagctttcccgataactataccttaattgatgtagaaactactggccttagcccatatcgtgatcggattacagagatgggtggtttaaaggttcgccatggagaagtagttgcaactttttcagaattagtgaagtttcctgatagtaataaggtgcctgcttttattaccaaattaaatggaattgatgaaacgacgattgaagaaaagggattacctgttcaagaggcaataaagaagtatcgtgaatttattggtagtgatccaattgttggatataatgttaattttgatttgaattttgtctatgacctagctgaaaaatatcacttaactgtcttaaataatgactatgttgatgtttatcgtttagctcgtagtttttatccacaagaacaacacaatcggcttttagattgtatgcatcgattagatatcgcagaaactcaagagcatcgcggtttagatgactgcctagatacaaaaaaggttttcgatgaatttcataagttgtttaagcaagaacatatgcttagagcacaagaaatggtcaaaacactagatttaactagtgaatggcctgagcttgttaagcaaagccaagctttccgtagtccgtttgctcataaaaatgttgtaattgctggtgacttagatgtagatgaatatgaactagctaatgctgtaaagaatttgggtggctttattcgggatgaagttggtcaagatacagactatcttttagttggagatcatgatttcttcagaacggatatcgttgaattaaataaggcaagagcattaaaaaagcaaggtcaaaatattagaatctggtcggagcaatttttcttgaatgttcttgataattgggcacgtagttaaaatatttttacattaaaaagggaatcctaaagcaggattccttttttgatatggggaagatttgcatgtacgagccaactaatattaattgaaacaataataaaagtgagaatggtaataacctcaaagcttgaccagatgagacaagaaatagttccaattaaagttgtactaataaaaagaaaaatagttgatttttttaacttaaattgcagtttattgtaatgagttgaaaataatagtcctaaatagaataaaccaattccacaatataaacataaaacagcaaaccatgagttagcatccgattcatggataaattttatacttacagtaattaaactaattccaaagattattaaatagtgaagatagattaatatattacctgttacatcctcttggtcttcattaattaatttatcgaattgtagtgcatacgtgaaaaagagcaaggcaacagttagaaaaataaggatagagtagaaggaaaaagttttaggttgaaagtaatcggcaataccaataattgtttcaccaaagataataattactaagagattcagtcgttcaagtaaatgaggaaaaataattggatgcttaagcgtatattttgtagtgagaagtggcattaaccagcttagtatgatgccgataacagctaaaataaagccaaaaatattatctaaaattcctccgataattaaggtaagagctctaaaaattaaaatcataaaaaatgcccgggaaatatttcgatcgacagaatttttaacttgaaagtaattgattaaatagtggctggctagagtaagagaaagtaatccagcagaaataaatagaactttcatctctgttagattattagtatcgaaagaattagacatgtaaagtaagatcatcatatcaataaagtaaaaggcaatgtcagcccaacttccgatcccatatctattagtaaagacagtctgaatcatccatgaattaataaaaataattacaatcaatgcaaaaagagcaaaagaggtgggtgaaactaatccatgctctagatgatgaagaatctctgttgttttagatatcatgtagacaaaaacaaggtcataaaacaaggcaatttttgagactcgcttatttaatatattttgcatccagcctacctactttctaaaattcctcatgttcattaggatcaaatcttcttgcagaaattttatctaaattgataagcttttgaacttcttcaggagttaatttgaaatcaaaaatatctaaattgctaatttgatgttcataggaactggctttgggaataggaacaacattaagttgagtttcccaccgtaaaattatttgagcgggtgacttatggtatttttgagctaagtcaataatttctttttcttgaaaagcttcaccagcacgttgcagcggactccatgcttcggtaatgatgttatgtttattatcatactcacgaattgtcttgctggaccagtacggatgaagctcaacttggttaatagccggcataacgcctgtttcacggtacaaatgttcaatatgtgatggctcaaagttagaaacacctactgagcgaattaagccaaatctttgagcatctagcatggcttgccaggcttcaagataatgattctcctttggatttggccaatgaataagatagagatcataataatcaagattagctgcataaagcgattcttgaatttgttctatggcttcctgatatttgtgatgacgccctggtaatttagatgttataaagatatcatcgcgatttataccgctatttttaatagcacgacctactgctccttcattttcataattaacagcagaatcaagtaaacgataaccgttctttagtgcggcttgaatagcaaaaactccacgagaaccatttaatttataggttccgaaaccaatcttaggaattcgatttccatcatttaaattaaagtattccattcttaatcttctttctattttcagtatacttattacgtttattgtaacagtctgaataaacaaaaacttattaattacattgcaaacgtacgttcaaatatctatactgaaagaaataatgttaggggaaagaataaatggcaaagagaagaagatatcgaaaaaaacagaaaaatacagtagcaaattggattatagcgctagtaattattatttggggtggttggtttaagcttaattcttctaatcaagtagcgaatcaaaatcagaaccaagataattcccagcaagtagtaaagaatgcgacaacagcggatactaattatggtggattatcaagtgctgactatcaaaaattagctaatttagactttaagagtggggacaaggcctatgtctatgtaaataataataagtctactttgattaaaaatgcctggaaggttaataaggtaatctattctaatttagataatttgaatcgaacttctcattcaaatactgccttcttagagccaagaaatgtagcaaatgattctttacgtgtaagacagtttattaatccaactgcatggcattctaatcgtgaaaatgggactcaaatttataatcgtggacacttaattgcttattcagtttctgcaggaattgatcaagatggaaattataatcctaataatcaatcaggtgatcaaaataatcctaaaaacctatttacacaaacagctttttctaaccagaaaattcagactatttttgaaggaaaagtacgtaatgccttaaaacaaggtaataaggttatttttcaggcaacgccaatctttaggggaaatgaattaatggcacgtggtattaatttacaggctataagtttaaataataatttagattttaatgtttatatctataacgtgcagcctgattatgtatttgattataataatggtagggctaaaatagatcgtaatatggtagttaatcaatagttaatttttatatttatatgggagaaaataatgaacaaaagcaaggataactgtacggcaatgattgtcggaaaaaaagctacaattgatggctcaactattattgcccgtgatgaagacggttatggtggtattaatgaaaagctttttgttgtccatgaagcaagagactatgatgaagaatacgtttcaaaatataatggtttaaagcttcatctaaagggacacggttgcaagtggactgcaactccaacagctgatgaatcagaaggccgctgggatgaacagggaattaatgaatataacgttgctatgtcagctactgaaacagaggccacaaatgcacgctgcttaggtcatgatccattggtagagaatggaatagatgaagattcgatggtttacctggtcttaccatttgttaaaactgctcgtgaaggagtagaacggttaggtaaattaattgaaaaatatggtactggcgaaagtaatggtatcgctttttctgaccacgatgaagtttggtattttgaaactggcgctggtcatcaatgggtagctcaaagaattcctgaagattcctatgcaatttgtcctaatatcatggtgattcaagatattgattttgatgatcatgataattttatgtatgcatcaactattcgtgattttgtaaaaaagaatcacttaaatccaagtactgacggtaagtggagctttagagatatttttggtactaaagcagaagcagatagttactataacaccccaagaacttggtatggacaaaagctttttaatccaagtattgagcaagatccgttaagtcaagaaatgccatttattagaaagccagaaaagaaaattggcgttgaagatgtagaatttttcttatctagtcactataacggtactgaatacgacccaatgggatcttttgcttcaggggatgataagaagcaaaaaatgtttagatcaattgctttggatagaaatcaatctagttgtattcttcaaattagaaatgatgttcctaaaaaaatggcaggtattcaatgggttaactttggtttttatgcttatagtccttatgtacctttctataccaatattgatgacacaccattaaattatcaaacagctagtcatatggttactccagagtctagtgcatattggttgtataagagtttgcaagttttagtagagccaagatatcatcagtttatttaccaagttgagaattttagagatgaatgtcaaagttatgctgttagccgtatctcagcaaccgatgagaaagcaggagaattgtctggaaaagaacaaactaagtatttaacggctgctaatgctgaaacggctgcttatatcactaataaaaccaagaaattgataagtgatttgacgagacaagcactaaattcttctaaatttcaatttgaacgtggcgacaatttgtaattttttgaaaaacactgcacaagatgtagtgtttttttattgttcgactttctctatcttgtatgttggtaaaacagattccaaggggatatctaaaaaatgcaagaggtaaaatacgatttatttttatttttatataagtattgttcctgaaataatattattatccacatcttatccacaaaaaagcagaaaaaattcacaaagtacgaattatttattgaaaaaatatttgtgattttgttgcttttatcataaaatttgtgatgtaatatgatttaaatctaaatgtagtagtgagagatatatgaacgaagataaattcattcaggtaaataacctagaaaaaacttatgagaatggttaccaagcaattaagtctgtcagcttttctgtaaagaagggcgacttagtgtgcttgttgggtcctagtggttgtggaaaaactacaactttaaatatgattgccggactattgaatccgactggtggagacattattgtaaatggtaagtctcttcttaatgttgcgccaaaagatcgtaatattggctatgtattccaaaactatgccttatacccacatatgactgttttacagaatgtaatgtttccaatgacggtgggaaagaacaagaagccaaaagatgaagctgaaaaaattgcccaaaaatttatgaaattaactcatattgaagaattagcggatcaaaaaccgggcaatctttctggtggacaacaacagcgtgtttcgattgcacgtgcattagtgcaagaaccacaaattttgttaatggatgaaccattaagtaacttagatgcccgcttacgtttaaagattcgtgaagaaattcgtaatttggttaaggaagtaggaattactactttattcgttacccacgatcaagaagaagcactctcaattggtgataagattattcttttccataatggagtaattcaacaagacgataagggtcaagacctttatcttgaacctaataatcaatttgttgctaactttattggtaatccagtaattgataattttgatgtaaaggtagcagacaataagattattggtacagactttgagattccagttggaaaattagatagtgcaaaatttagaggcgacttagtagccggagactatacattgagtattcgtcctgaaaacctaaagttaagtgatgaaggcgaactttccgaagtgattgatgatgtcgaattgattggacgcgaacgagtattgaaatttactcatgctggaacaaatcagcgtgcattgattgatttagaacaagaaataaaacctggagatagcgtgaaatttaagatgaacttagaccgcgtttacttatttaagccagatggggagcgaatctattaatgaaagataatcagaaaaaagcttggttatttttagcaccggccattatttgcgttactgtatttagtatttggccaattctacgtgcttttacgatgagttttcagggtggaccattaattgacctacaatttaatggcctttctaactatcaatatatttttagcgatccagaattttggcgtgcaattatgaatacagccatttattcatttttagctgtaccaattgccttaataatttctgttgcgttagcatggtttatcttttcaaagattaaacataccgccttctttgaaactatgttttttatgccatatgttacaagtacgatcgcaatcggaattgtatttcgctatatttttaatggtgaatacggtttattgaacttcttgttaaaacttgttcatttaccacaacctgattggttagataatccgagtctaagtcttgtttcattgattatctttggtgtttggtcatctttggcatttaacatcgttatcttgatgggtgcgttaagaaatattgaaccaaattactatgttttagctgatatgtatggtgcaacaagtagggaaaagttctggcgcataacagtgccacagttagtcccaactttagcctttcttttaactgtaaacttaattggggcatttaagatctatacccaagtttatgcattatttaatggacaagctggtgtgggtaattcggcaatgacggcagtttactatatttataataaattccaaattgttggtacgcctggtgtagcaatggctgcaacagtagtcttgttcctatttatattgttcgtaactttcttacaaagaaaattgatgaaaaaggtgaacagttagaatgaagaagaaaaaactacgttggggaatgatttttgtctatctattcattggaatttttggcattataactgttttcccatttatttatatgatcttaggtggattgatgtcctatcaagaaaccaccactattccaccaactttaattccaaagactttgaggtggagtaactatcaaaaagtatttgagcaagcaccatttgcaagatacttcttaaacacatttattacagcggcaactacaacaattgttacattgtttacttcaattctcggtgcatttgcaatgaccaacttgaagtttaagggaaaaggatttattcagctaatttttctctcactcttaatggttccgggagaagcaataatttttaccaactacaatacaattgctcatttaggcttattgaatacatatttaggattggttttaccgttcttaacatctatcttttatatgtactatttacaaagctacttcacagcaatttcaccaacaatttataaagcagctatgattgatggagcttctgactgggagtatatttggaaaattctagttccaatgtctaaaggtggattaattactgttgccttgcttagttttatttcaggatggaactccttcttatggccattattggtaacaaatgaagataagatgcgcttattgaacaatggtttagctgcctttgcttctgatgcaggtgctcaaacgcaacttcaactagcagcagcaactttaacagtagtacctgttttaattgtttacttcatttttagaaagcaaattattcgaggagtagtacgtaatgacctcaaagcctaaaactacagttactttttataatgggttaacgactattggcggcccaatgattgaagtagcttatgataagtcacatgtattatttgatttaggagaagtgtaccgtccagaactgggactgaaaatggaagatgaagatttttcaactcttcttaaatatcaattgattggtgatgtaccaaatttctatgatccaaagattacgggaaaagaaatagatcacgaacgttggcaacacagcgcagcttaatatttctcatcttcatttggatcatagtaaagctatgaatcttttagcgcccgatattccactatatgctggtccattaactgcggcgttgctaccagtgttgaatcgggatggggagtttttattaccagcagctgataaaccaaagaattatactcgtcctataattgctgctaaattaaaccagcccattaaagttggagatataactttaaccgttgttcctagtgatcatgatgcttacggagcaactgggttaatcatcaaaacgcctgataagacaatcgttcatactggggatattcgcttgcatggttatcatcccgattgggtgcgtcaatttatggcggccggtaaggaatgtgatatgctaattatcgaaggtactggtgtttcatggccagaacgtagtgaagaggatagtgaagagttcaaaggcgttaagaatgaggttgaacttactgaaagagtagttaaataccaaaaagataatccaaaacgccagttgacttttaatacttatcctacaaatgtagagcgaattttgagaattatttcagattctcctcgaaaagtagtccttcatgctaaacgtgctgaattattaaaattggcattacagcaggatgttccttactactacttgccagaagatgaaaagattgatgcgctcgatccaaatcttgaagttagttatcaagatcttctaaaggacgatcatcaatatttctggcaagtagtgggtcattatgatcaactacaaaagggaggcttatacattcatagtaatgctgagcctctgggagactttgatccagcttatgctccgtttattgaaaatattgaaaaacgtggaattgaattgataactctacgttgttcaggacatgcggatgtagctgaattaaaagaaattattgcgggttttgagccaaaaattttggctcctgtgcacacattgcatccagaattagaagaaaacccatttggagaaaggattttacctaagcgcggagaggtatttacgcttagttaaaattaaaattttattttgttgtttgtttttattgggaggaacatatgaagttcactaaaaaatttgcagcagttgcagttgctgctttagcccttgtaggcactactgcttgctcaaattctaagagtaatgatagctcaagtagtaagtcagctgatattccaactaagattaccaagaaaactactgtagttttctggcatggtatgactggaactcaagaaaagactttacaaagcttgactaaggattttgaaaagaagaatcctaacattactgttaagcttgaaaaccaaggtaagtatactgatttacaagcaaagattaactcaactttgcaatcaccaaataacttgcctacaattactcaagcttatcctggctggcttttaaatgccgctaatagcaaacgcttggttgatatgaccccttacattaacaatagtaagattggttggggctcagctaagaagagtgacatccgtgaagaattattaaagggtgcacaaattaagggtactcaatatggtattccatttaataaatctgttgaaatgttaacttataacaaagatttattagataaatatggtgttaaagtaccaaagacaatggctgaattaaaggcagcatctaagaagatttacgaaaagagtaaccacaaggttgttggtgctggattcgactcactttcaaactactacgttttaggtatgaaggatgaaggcgtaaacttctctaagaacatcaactttactggttctaagtctaagaaagtaatcaactactatgctgatggtattaaagctggttacttcaagactgctggttcagctggttacctttctggtgacttctctaaccaaaaggttgcaatgtttgtaggtactagtgctggtgaaggatttgttaagatgggtgttggtaataagttccaatacggtgttgcacctcgtccttctaagtacaacatgcaacaaggtactgatatctacatgttcaacaagggtactgcagaacaaaaggcagctgccttcatgtacattaagtacttgttaggtaagaaccaacaattgacttgggctgatcaaactggatacatccctgtaactaacaatgtgattaactctagtgcttacaagaactcaactaagtctaaagttcctgctcaattagacaaggcaatgaagaacttatacagtgttcctgtagttaagaacagcaacactgcatacactcaattgaattcaattatgcaaaacatctttgcacaagcaaagaagggtcaaaactggaattcacaaattgatgccggtaagactaagttcgaaagtgcttggaatcaataaaaacagaatattaagtaaaaaatgaggactgtcattatgacaatcctcatttttttatagatgttttagaagaaaagtagaatgaaggcaattaatgcaggtagcatttgaacaacaaaaatctttttacttgctgtaaagcccccaaaaatagcgacaactacaacaaaggcaagcaaaagttgccatacagtgattaaagttggcattctgaagaagaaaaatacaattaagattaaaagacctagcattccattatagataccttgattagctaaagctgtttttgcggcaggctgtttaacaaaatctacatccatgtcaaacgacttggcttgtaagtctggtttcccaaaaatttctaaccacataattccaatatgctcaattccaacaataattgttagaagaattccgatatttcttaaaatcattttataatctcccttatttaactattcagatagattttacttattgttaacatagaaatcaaatagagtaataatcatttctattattgtcgcatttgcaacaataataacatatactagaacaaacgaataggagggatagacataaagatggcagaagaagatattttaagagaaattggttcaatttcacgagccttagattcgattgctaacattgagtttaaagatttggaattaaatcgtggtcaatacttatatttaactcgagtttttgaacaccccgggattatttctgatcacctagctacattattaaatattgatcgtacaacgactgcccgtggaattagaaaacttgaacgagagggacttatttttaaagaagatgatgaaactaataagaaaatcaaacatttatttgtaaccgacacaggtaaaaaattagctaaagaaatagaaagagaaaacgtctattcaaatacgttagtaacaaaaggcttaactaaagctgaacaggctcgattacaaaaatatctaagtgttctcgagaaaaatgcacgtgaaagttggaattttgtaaagaatggtggaaagaggaagtattaatatgacagtaaaatatgagattaaagaagtactagcagataatattagagaattacaacaaatttcaagacaaacatttttagaaacgtttggatcacaaaatagtgccgaagatatgagagaatttttggatacagcatatgcagaagaaaaattaaaagatgaagttgaaaatgcgaatagtagtttttactttttaactgtagataataaagtggctggctatttaaaggtgaatgagggagatgcgcaaacagagcaggtggttcctaatgctttagaagtcgaaagaatatatttgaagcaagattttcaacatcaaggtttaggattagtgctaatcaaattagctgagaaaatagctaaagaaaaagataaggacaatatgtggcttggagtttgggagaaaaattatcaggctcagactttctatgaaaaagatggttttaagagagttagtcaacacacttttgtagttggagaagatccacagacggatttgattttagttaaggggttgaagtaatgaaattttgttttaagacaattgatgaaatgactggatatgaggctttttgcgtcgaacggctaagaaatgaagtttttgttagtgaacaaaaaattaccttacctgaaatagatgatgaagattttcatgcaattcatgtttttagtttaaatgacggaaaagatgatgctttagctacttgtcgaatttttaaagatggaaatggagattggtatttaggtcgagttgtggtctcaaaagatgcacggggaatgcatcttggaagtaaaatgataaaagaagttcatgagtacctaaaagaaaaagatgttaataggttatactgccatgcgcaaatgacggccaagcctttctatgatcatcttggttatcaagttaaaggtgatatatttgatgagggcggtatagaacacgtattaatgtataaagatctatagataaaaaagcacctcggagatcgaggtgcttttatagtgtttaacttatttattcatcatcgttatggttagtgaagtagcggtaatctttactcttatcaaaaattacaccacgtgcgttttcaccgtttgaaacgctaaatactgcgtctgggtatttttctttaacttctgcttccatgtatgaacgcatcatagcgttgtttgaaagaactgaaccagttaaagcaatgcgcattggcttaggatcttcataacggtctaagcacatgataatgtcacgagccaaaagatgtgcttgatctgcaatgatcttacgagcatcttcgtcaccgttatctgctaacttagcaactttaacagcctttgaagcaacttctggactagttaagttatagaacttagcaggaacttcacccatattatcaacattgaattctttaacgaataaatcaattaaagaattcttttcacgcttgtcccagctaagaagagcagattgaagagcagccttagtaatagcataaccactaccttcgtctccaagtaaagaaccgtaaccaccaacagcgattaaagagccattttgacggccgttaacaacggatccagtacctgcaataactaaagcaccatctgctccttcaagaccattgtaaagagcaagaagtgagtcagtaatagcacgagttggaatgttaccaaccattgaagaaatagttgctgcgacttctggtgcattaccaacaacagataaaccagcaattccggctaaaaccttaatacaatcgccatcaatcttgtcacgcaattcattaactgcttgagcaatgtttttgataccgagttcgtagtcattgttgatttgacctgggccagattcagcacgatctaattctttaccattttcatcataagcgattgccgtagagtgtgtaccacctgcgtcaataccgatcatatattttaacataaataataatccctcactgtaaatattaatactggaattattgtactaaaaaaagagcaatttgtgaacgcattcagcaaatcctgtataaagaaaagataatcttaaaaaatagaataatccttagtatttaaagcttttttaggtattagcatgataaaataaaaaatatgtgattaaggagatttttaatgaaaaataaaatatttttaggggcgattttatcctctttttgtgcattagctttttatatgactagtattaatcatatgaaaacacaaactttagaaatttatggaaattcaacagccaaagtagctcaaaaaagtaaaatgaaagaaggcactaaacaagctcgtattactagtggagaaagcgagattggagaggctgctatttcaaaaaatagtaataaaagcttagctaaaaccattgttaaatctagttcaaaggttctaggaagctaccaagtaagtgtaaaagacttgaataattctaacatatttgctgatttaacaaatactagtcaagataatttaaatgctgggaatgttctaaaattatttgtgttgctggcttattataaggcagttcaagataaaagtttaaactcggcgactccttataaagttaaatcaagtgacttaaatggtggagataaggtattaaagactgatatggcttattcctatacatatttactggatttgatgatgcgtcaacaaaataataatgccgctaatattattttgaataaaattggaaaagaaaaagtaaatcaaactgcaaaagaatttggtgcaagtaatacggaaatcaccgataattttggtaaagattttgctggaaaaacaagtagtagtgatctagttaatactatgcaaaagctttatcaggggaaaatcttaggaaccaatgtggataatcaaattttaggacagttagctaatttccctgaaaaaggcttagcgaaaaacattaatggtgtggtttatagaatagctgataagaaacaaggtgcagctataattcaagaagatggaaaaacttacaccatggcaatggttagtgaagaagatgctgatctagctaaaattggggattcgattaatagttggatgattaaacaaaaatagatttaaaggagttttataactcctttttattttttcaaaaagtagataaatttctacacattgtagattgttttctacagattgacgtgttaaagtatatgagtacataaaaagaaggtgattatcttggctaaaaaaagagctttggaccgctcaaaagtaattgatcaagctataacaattattagtgaaaagggattaagcgaattaacaatgccagctttggctaaagcattgggaattaggtctcaatctttgtatcactatgttgctaatcgtaatgatttattagttttagtttgtgttaatagactgcaagttttgcgtcagcacttaacaaagaagataataggccattcaggtctggatgctttgtttagatttgcagatgaaatacgagattttttactacatgataaggctatttctggcatttactatggactaaatgaatatgttcaaaatgaacaaattcgtgaagaagttttaaagatagtagatctaggagaaaagctagatgtaggcaaaaagaatgttgtttctttgcatagtttacttggagctgttttgggttatgttttcttagatcgatatgtgattgatgaaacagaaaaagaagctgacgataattaccatgagatgcttttaagacttgtagcgccaaaactccaagttgaaggtacgaaataaggggaaaggaaagtagcacatgaaattgctgaaaaatcatcttggtgctttgatagcatggatagcaattttactaattgctgtcttctcgttgccaaatgtggatgcattgacacgtcagcattcagaaatttcacttcctaaagatgttcaaagttctattgcaacgaacatcgaaagtaagtgggggcatggacaagataatacctatgttgtaggggtagtttttaataaaaaacacgggaaactaacctcgagtgataaggagaaaattgacgatacaattcgctttttaaaggacaataagaaaaagcttggtattaagtcaatgatgactcctaatgacaactatgcaacaaaagcacaattaatttctaaagataaaacaacagaaattgtgcaattaaatattgctaatgatcattcgactgtttctaacgttaataagactttaacaaaggctgttaaaactccaggagttagaacatatgtaactggggttagaattcttgaagatgatttctcggcttcggttcaaaaaggtattaaaaagactgaattaattactatcttctttattttcattgttttagtaattgtatttaagtcgccaattgtgccaataatttcactattaacagttggtgtttcatttattacttcattctcaattgttactaacttagtagagagatttaactttccattttcaaactttactcaagttttcatggttattgttttgttcggtattggtactgattacaatatcctgctgtatgataaatttaaagagaacttgagtaaggggatgtcgaaccatgaggcaacaaatgatgcgttgcgtaaagctggtaagacaattctttattctggatcttcaattttaattggatttagtgccttaggtttagctaatttctcaatttatcgttcagctgttggggttgctgttggggttgccgtattattggtagtacttttaactttaaacccattctttatggctgtcttaggtaagaaattattctggccagttaagaagtttgaaggtgaaagcaactctaagttatggcatgctctttcaaaagggagcttgactcatccaattatttacttagtggtaatggcagttgcagtcttaccatttgccttattctattcaaataatttgaattatgatgatgcagatgaaatttctaattctacaccatcaaaagctggactattagttttacaagatcatttctcaattggtactcctgaatattcaactttatacattcagagcaaaaataagcttgataatgaaaagagcttaaaagaaatcgatcaaattgttaaaaagattcaagcagatccagatgttaaatttgcatcttctgtaactgaaccaaatggaaaatcaattaaacgtctttacgttgacaatcaattaggtactgttaactcaggtgttaatactgctagaaatggtttgggaactttaagtaacggtagtaaacaaattactaatggtgctgttcaactacagaatggtgcaaatcaactttctaacggaactggccgtctgcaagctggtgcaaatcaattagctagcggaactacacgtcttcaaaatggtgcagaagctcttagatcaggaactatgcgtttagcaactggtgctggtcgtttagagagtggtactttgaacttacaacaaggtgctgtacaacttgaaaacggaactattaagttggctaatggggctgcaagtttacaaagtggtactcagagtttgcaaaatggtactcaagccttagtaaatggtttgaatactatgagtgcacaattatctggacaaatgaatagtgctactaaggcacaattagatgctcttcaaaagggattgcctcaaattaataatggtattcaacaattgaatcaagcattgggtcaatcatcaagttctgtagatactgctggtctaaaagctaatctaactgatgttggtactcaagccaaaactataggcgataatttaactcaagcaggtaacactttaaaaggtttacaaagctcaggtgctggtcttagcgatagtgaaaaagctgagttaacacaagcttatgctcaagctatggatagtgctaagttaaatgatcaacaaaagcaggctatgagtgcagcctttagtcaaattttaggtaaagtagaatctgcttctactcaaaaaactcagaatcttacttcaagcttacaaagtgtagctggtaatattcaagcagctggtgaagcagataagaaacttggagagtcagcaaataatgtaggaaatactttacaaacccttcaaggtttaatgggtcaagttgataacttgaaacaacaagtaaacactttagctactgcatcaaacactgctttaccaggcgcaactactgctttgaaccaattaagctcaggcttaacccaagttcaaggtgctgtagctcaaggtgctgccggtgctagtcgcttaaatgatggcgcagctcgcttaaacagtggagcaggtcaacttgcaagtggtttacaagcaggtgtagctggttctagtcagcttgcaaatggtgccggccaattagcaaacggtgctggtcaattaaacactggtttacaatctggtttaaacggcactaaccaattggcaaatggtattggtcaattaaacagtggtgcaggtcaattaagttcaggtattggtcaacttaatggcggtgcaaaccaattagcaaacggtgctggtcaaattgcatcaaataatcctaagattaccgccggaattgacaaagtaaacagcggtttaggtgctggtcaagaatacttaactggcttagctgattcagcagctggtaagactttctacatcccagcaaacatgattcactcatctagctttaaacctgctcttgataactacatgagttcagatcttaaatctactaagatcatcatcattctaaagatgaaccctgcttcaactgaaggagcaaagaaggctcatgaaattagcaacatggttaagaaatcagttaagggtacaagtcttgctggttcaacagttgcaatgggtggacaatctgaaaagatttacgatactcaagaaactgcaagtagcgacttcttaagaactgcaattattatgttagtaggtattggtattgccttgatctttgttactagatcagtattacaaccaatgtttatcctaggtactttagtaattgcatacctaacttctttatcaattaatcaatggattgttaaggctgttttaggtagatcattattggcttggaacactccattcttcagcttcatcatgattgttgctttgggtgttgactactcaatcttcctaatgatgcgttatcgtgagttgggagaagtaaaccctggctggagtacaagtcaaagaatgcttgaagcctgcgatattatcggaacagttgtaatatcggcagctattatccttggtggtactttcgccgccttaatcccatctggtgtgccaactttaattgaagttgcattatgtgtggatattggattattacttttggtattcttacttccaattaatatgtctgctgccatgaagattacttacgaaggcttaggcagaaaaaagaataaagaagaggctaaataatatttagttctccgagacaaaaaagattgaagtttatccttttgtgaatgaggattaaaacttcaatcttttttagttaggaattttatttaatactgcagcaattccatcatgatcattatcaagagttattggaatggataagctctctttcaagtcttttggagcatttcccattaaaacgggatgaccaactgaatcaaacattgattcatcattataattatcgccaaaggcccaagcattgcctttatccattgcaaaactatcaagaataattttaactgcatttcctttattaacacccttaagaacgacttctaaaagatgaggtgctgatttaacaaaaactaggctagggaatttagattcaaggctagggataattttatctataagagtaggtttgccgataattagcatcttatgaactccctttaattcttttatttgctctgtagaaactggcaaagatttaactcctattgtttcttcctctttggcaattaatggttttttattaagagaagaaaaccagttatagccactatagacattccaggcaagatcattagtatcaagtgcttcaatttcttcaattaacttaagagcaagtgaagcttcgaagaattgtgaattaagtggacgccccatttcatctaaaactaatgctccattataggcaatcattggacagaaattggtaattttatctactacattcataattcctttaggaaaacgggcagaaaccggaataaataaattaccagctataatttgtttacgtattgcctcaatagtagtagaagagacgacaccttgagaagtaataagagttccatctatatcactaaagataagttttgcggacattttttcctccttttgagatagctttatttttactattataatacgataaagtataagaacgaatggataataatagttttgataattggtctgaaacgtgaaaaaatatgattatggcatatgaatttagaataaacgagtgaaataatgacaaaaaaattgagaaaaatattatttataatctgtgggattttaacagcaggaattttattatacttgctttatcgtgactatcgccctgaaattgatttattaatgcacccagggaaggatatgaaaacaaaactactctatttgcttcgacaacacgaagtacgggatggcttatttttactaggactaataaccatcttaaatgcgattccgggaatgtcgaattctgttttttgtattttagccggtctttgttatggtccgtggattggattagccattaattggtgtggaaatgttcttggaaactgtatcgtagaaagtctaataaagagagttagtttttcgcacaagtttaagaaaaatagatttcttaattggttaatgaatcagaaacatcccactttgggaatgactttaggtttcatggtaccagttataccaagcgtgttagttgattatacggctgcacgactagaaacgccgcctaataagtttttgtcgatggtgattgtgggaatgtttcctacttcatttatctatgcctttggaggggatgcaatcttcaatggtgatatcaaaaaattagctggtgcgttaatcgggatcgccattttatttattatggcttggtggttagttaaccgcgcatcaagaaaaaaacagaaagcagcataacgatgctttctgtttttttagtttaagggctagaatgctataataagctaaaaaagtttatgagggaataaaaaatgaagtgtccaaattgtggagaagatgtaaagccaactgacaagcagtgtcctaattgtcactttgacctagaaaagtttagaaatgaattctttactggtcaggatactacccgtaatgaaaaaaatgatgatcgtcggaaacaagaaacacgctctgttaagaaagttgagccaaaaaaacaaaattctaccattgctactatgattaattggattcaagtaaattcaatgattgtttttgtagttggaattattcttttgattttaacaagtttttctccatccttaggatggtcttgcttctttgccttattaatttggttatttatagtatctgataagaataagggaaagaaaactgagcaatatacagtcgatcaacgattgacagaacatgttaataaggttggttccgatgtagttaattcttttgaagaaggagagagcaaagtaagggctcaccgtcaaaagattgatgataaattaggtcgggatccagaagctataaaaaaagttgttaagcaaaaacgaactgcaactcaattaggagtaatcttaatcgcagttttaaacttacttttggtttttagcggtccgttttcatctggaatgatgcaaggctatcaagctctatctatctctaaggcgctcctttcaattggtagatttaatgggaaatatatttttattggttatgggatgtggctacttttagttggtgtaccaattgcaatcattatcttaactattaaaaatggtaagaataataagaagctagttttcttcctttcattaattgaatcaattgttttaatagtttgtgctgtagaattgatctttatgaatgctggatctcctcttggtattaccaataatacagtagccaatagcattgaaattcaacgtattgttgcgaatgcaatttcttttggagtttcgacatatttattatttgtatcaagtattcttttaacagtagttgcttttcgcagtatgagacaaaattaaaaaggcctagatcaatattgatctaagccttttttgtacacttaaaaattattttgaaacgtcaataactaaatgttcgtttacaaatgacatcaagccgagttcactaagttcacgaccatagccagattttttaacaccaccgaatggtaattcaggagcggtaatccagcgcccgttaataacagtcatcccggtttcaatttcacttgcaacttcttgggcatgagttctattttcagaaataacactagatcctaaaccaaagcttgaattatttgctagagcaattgcttcttcttcgtttttaaccttgaatacttcagcaactggcccaaacaactcttcatcaaataatggattcttcttatcaatattagttaaaatcattggccggaagaaggcaccagaacttttaatttcaggatattgataagcaacttctgcaccatgttcaattccttttttaacttgctcagctaacttatcagcagctctttgagaattcattggtgcaagactagtatctgcatctaaaggatcaccaggtttaagtccagcaaaagtatggtgcaagatatccattacttcgtcataacgggattcaacaacaataattcgtttagaagaggtgcagacttgaccgcaattataggttctggcatcacttagtacattctttaatacagtagagtcagcatctgccaaaacaataaatggatcatttccgcctagctccattgtcgactttttaatatttttaccagcagcttctgcgacactactaccaccacgttctgaaccagttactgcaacgccttgaacacgtttatcagcaataacatcgccaatttgatcataagataggaataagttttgcagacttccttttggagcaccagcttcttcaataatttcttctgttaattgggctgagccaggaacattatgagcatgctttaagatgatgggatttccaaccataaaattaggagcaaagactctaattacttgataaagtgggaagttccatggttcacaggccatgataatacctgtagattgttttagataataggcatttcctaaagctgtttctaaaggagtaggctctaacatttcaggagctttatcagcataatagttacaaatatttatacatagatctacttcttcaagtgattcacaatacaattttcccatttctaaagtcatggtttttgccatttctttgcgatgtttttgaaaattatttgctatcttgtgaagtaactcgcttctagtagctggcagctgattatgccaagttagatataatttttctccggtttcaagtgcttgttcaatttcttcttgagttgcagttggataacttttaattaattggtttgtatatggattaattgattcatatttagacataaaatttcctcttttcaatataatatattataaagcgctttcttatagatgtatataaaaatcacttctctttagtaagaaattaaaaagaagtgattagatttaagctaacttattaattttttctagtaaaacatgattattattcagacgagcaaaggcagcggaatcattcaaatattgagcagtcttttgtggcgatccattctcggcaatattattttgtgccaattgataaagaatgcgagcagcaaagtaaattacatgtcgttttttgcataaatcgtatcccatgtttaataatttatccgattgttcataatcgtcattacgaccataaaattctccaccattacaaagaatagaaagaaattgtagtaaagagtcttcatcttcaagcggaacattagatatcgaagacaagatgatgtcataataatgtcgtgctttatgaacatcgtcttgtaagtcataaacttgactacatccttttagagcaagaagataataaattttatttcgttttgataagtttgcatctaaaattgaattaaagtagtaaagtgcgtcagttttagcatgatctaaatttaaagctagtagaccgcgcagataataatagtgaagaatatcttcttggcggactaattcatccttattaacactgcttaaaatttgagcaacttttggaaaatcaagctgaataacagcaaaatccgcctcaaataatttatgggatgtttttttattagagtcaacgtccatgatatcagctacattaatattcattcggtcgcacagactatttaaaatttttagagaaggaatacggccattattttcaaatttacttaatgtagattgagtacaaattccattgcatagttcagtttgagacaaacctaattttttacgaatggaaacaaatttgttaatgttgatcattcttcttctccttgattgtctgatacaaaaaatctaaagattcatcaatataatccatggcgtaatccattgcatgccgatgacctttaatgactaataattcaacctcatgatcattgttagctaaaaagtcgataaattttaaaacaccatttagtggaactaattcatgagcagaattaatcatttttagccttcccaaatggctaagatcataattttcgacatccattttttttaaaatagcttgatcatttttcccagcataggtttttacaaaaaatttatagaatgattcaaaaatatcatataaatttgttagttttaactcattggcaccatatcttgatggaataacatcttgatgatttttcatccagttcgagaagtctaccgatgctgaccacgtaaccgtaggaaaaccgtaaattccagcaatatacaaagctagtgtaccgccgacacttgcaccaatttgtacaatattttgttgatcatcatcatcggtataatcagaatctaaaagccattcaacaaatttcttactatcttgatgtgcagctggataagtaaattcaggtgctaagcgataatcaggaattaaggtcataaaaccagcgtttgcgaattttattcctaggtctttaacatcgtttttagaaccagcaaaccatcctccgccatgccaaaagattaagagttttgtttgtgaagtagtatcatttggaaaatagatatcagtcttcaaattgttattttcatcgtaaattatatctttttttataacaaccatagtcatgcctcttagttattttataacacactaatattatagaataaattttaatgatgagtcatatcttattttcattataattaagtttaattcctaggttagtgcgcctattttaccttgtttttgttatcattaatttaacataccaaggagggcagaaaaatgtctactaaaacgagtcgtaaattaattaatattttgaccattgttactacaattattctaattttgctaagtatttattggtatagattaggaatttttacaagccaagaaaaaatgaaggcctatctagcagacaagcaaattatcggtcctttgatttttacattaattcagataatacaagttgtaattccgattatccctggtggagtttcgctgcttggaggagtaatattttttggtccaatatggggctttatttataattatgtcgggatatgtttaggatctattattttattcttcttggccagacattatggtagaccctttatcttacatttagtttctgaaaagacgtatgaaaaatacatgaagtggacagctaatcagaaaaaatttaattggttttttggtctgtgtattattgcgccaatggcgccagatgacattttatgtatgattgctggattaactgaaatgaagttctcaacatatttatggataattttattaggaaaaccgtggaccattgcagcctatagtttagggttagtttatggtgcaaaatggttagtaaagttagtaggcaagtaatgctagaaactgagagaattattttaagaaaaattgaacctaaagatgctcctacgcttcttaagtggggacaggataatatttatcacaaaagtgcaggttaccaatatttacaagatttagatgcggccaaaaaaagtgcccttcaatatcaagcacgtccctatagttacggtatagtactaaaagaaaataatcgtctaatcggcttagttgaattatatgaacgtggattagatgaatacaatggtcttttactaacaaaagatttaggttttttgttagataaagaatattggcacaggggtttaatgaccgaagccttacgactaattattgattttgcttttaaagaattagagcaaaatcaaatttgggcgggtacatttgtttctaatacaaattcacaaaaattgttaaaaaaattagggtttagatatgtctataccactgattattcaatggtttcttcactttttaattatcaagaaaaatattatttgttaacaccacaggattggcatgatataatgcaaataaacatgaaatcctaagactagtttcagagagctcatggttggtgtgaatgagtaaaaaagtcgtttccagatttcgaatgtgggtaggtaattctacacggttagcaccgttatcgctttttgagtgtggtattttttaaccaaatgtgggtggtaccgcgaaccgtgtaagtcgattcgtccccgtgtagggatgagtcggctttttgttttatttttaaggaggaaatatgttagacattaaagtaattcgagagaatttagactggtcaaagaaaaaattagctacacgaggaattaaaccagaggaattagataaattagtagctattgataaagaaagacgtgaagctttaactaagagtgaacaattaaagcaaaagcgtaatgaagtatctgatcaaattgctcaagctaaacgcaataaagaagatgcaagtgatgctattaaagcaatgcgtgaagtaggtaaagaaattaaggatttagataaagaagtagaagatttaactcaaaaacaaaactatatcttacttcgtttacctaacttcccagcagactcagatcctattggacctgatgaaagttacaatgaagaagtgcgtaagtggcatgagcctactaaacttgattttgaaccaaaacctcactgggaaattggaacagaattgaatattttagactgggatactgctgctaaagtttcaggtgcccgctttgtttattacaaaggtgcaggtgcattgcttgaacgtgcagtttcaaacttcttcttagatgaaaatactaaagatggatatactgaagtaattccaccatacttagttaacgatgcttctatgcaaggaactggtcaattccctaagtttactgaagatgtttatacaattgtagataatgatgatcctgataagccacgtgatttaactttaattccaactgctgaagtaccattagttaattacttccgtggcaagattttagatggagagcaattaccaattaatgtaactgcattctctccagcatttagaagtgaagcgggatcagctggacgtgacactcgtggattaatcagaatgcacgaatttagaaaagttgaaatggtaaaaattgttgacgaagaaagttcatgggatgaattggaaaaattaacccataatgctgaacatttacttcaaaaacttggtttaccatatcatgttgttgctctttcaactggggatgcaagttttactagtgcaaaaacttatgatctagaagtttggatgccagcacaagataagtatcgtgaaatttcaagttgttcaaactgtactgacttccaagcacgtcgtagtttgattcgttacagagacgaaaatggtaaacttcatttagcacatactttaaatggttctggtctagctgtaggtagaacagtagctgctattttggaaaattaccaaaacgaagacggaactgtaaatgttccagaagctttacaaccatatatgcatggaatgaaagttattactaaagagccaaaatttggtgaataaaatttaataaagtaagaatggtattcaattgctaacatagcaaaagaataccatttttttatatctaaaatacgagagaaaaggcttgaaattagcactctaaaaaaatattgctaattttttgcaaaaaagggttgacgaaaagtgaaaaagcctgtaaagtaatacatgctgtttgaggcaagcgaaaagagcaaataaaaaagttcaaaaaaagcttgtcaaagcgagcaaaagatgataatattataaagctgtcatttgagagagatgagaaaattaaaaaagttcttgtcaaagcttaaaagacatgatataatataaaagttgtcacatgacaacggtagtaccttgaaaactgaacaaagtttcgctgaaagtgtgcgggatataaaaatcccaaacaaaagcgaagtcaattcgcaagcaataaatttgagataactcaaagaaagttttagagctaaacgataaaaagctcattttcaaaaggaaaatgagagtttgatcctggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctcttaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttctaaggaaggcgaaagatgatggagagtgcgagagcactaagagaagtcatcgagaaagccaagcggaagcacactgagaaactttgtttagttttgagggtattacctcaagagctagtacattgaaaactgaatataatcaaaagcaaaaaaccgagacaatcgaaaaaacagattgaagagcgaccgagaagagagagaaactcaacttgaaataggtcaagtagaaaagggcgcatggtgaatgccttggcactagaagccgatgaaggacgtgacgaaccacgaaaggcttcggggagcagtaagtaagcaatgatccggagatatccgaatgggggaacccaataccgcgaggtattatcattaactgttaaggttaatgaaggaagacgcagtgaactgaaacatctaagtagctgcaggaagagaaagaaaaatcgatttcccaagtagcggcgagcgaacaggaaagagcccaaaccaactggcttgccagttggggttgtaggactgcgatatagtacttgaagtgatagcagaattatctggaaagataagccagagagggtgagagccccgtacgcgaaattgcggagagacttagcaggatcctgagtaggtcgggacacgaggaatcccgattgaaaccgcgaggaccatctcgcaaggctaaatactaactagtgaccgatagtgaaccagtaccgtgagggaaaggtgaaaagaaccccggaaggggagtgaaagagaacctgaaaccgtgtgcctacaagtagtcagagcacattaaagtgtaatggcgtgccttttgtagaatgaaccggcgagttacgttatggtgcaaggttaagtcagaaaagacggagccggagcgaaagcgagtctgaatagggcgaaagagtatcatgatgtagacccgaaaccaagtgacctacccatgaccaggttgaaggcgtggtaaaacacgctggaggaccgaacccacgtgagttaaaaatcgcggggatgagttgtgggtagcggtgaaattccaaacgaacttggagatagctggttctctccgaaatagctttagggctagcctcgtgtgaatgataatggaggtagagcgctgtttggactaggggcccgtcaggggttactgaatccagataaactccgaatgccagatatcaatgcacgggagtcagactgcgagtgataagatccgtagtcgaaagggaaacagcccagatcaccagttaaggtccccaaatctatgctaagtggaaaaggatgtggagttgcgtagacaactaggatgttggcttagaagcagccaccatttaaagagtgcgtaatagctcactagtcgagtgacgctgcgccgaaaatgtaccggggctaagcatagtaccgaaactgtggatgcatatattatatgcgtggtaggagagcgttctaagtgcggcgaagttagatcgagaggactaatggagcgcttagaagtgagaatgccggtatgagtagcgaaagataggtgagaatcctatccgccgaaagactaaggtttcctggggcaggctcgtccgcccagggtaagtcgggacctaaggtaaggccgagaggcgtagccgatggacaacaggtagaaattcctgtactgaaattgttcgatatgagcaaaggagggacgcaggaggctaatgacgcatgttgctggaaatacatgtgcaagcagtaagaaaaaagatgagtcaaatgcttgtctttagatttcaagctgtgatgcggagcgaaataaaagtagcgaaggtcatgatgtcacactgccaagaaaagcttctagccagaacaattttacccgtaccgcaaaccgacacaggtagtcgagtggagaacactcaggtgagcgagagaactctcgttaaggaactcggcaaaatgaccccgtaacttcgggagaaggggtgctgatagtaaaatatcagccgcagtgaataggcccaaacaactgtttatcaaaaacacaggtatctgcaaaatcgtaagatgacgtataggtgctgacacctgcccggtgctggaaggttaagaggagagcttagcgtaagcgaaggtttgaattgaagccccagtaaacggcggccgtaactataacggtcctaaggtagcgaaattccttgtcgggtaagttccgacctgcacgaaaggtgtaatgatttgggcactgtctcaacgagagactcggtgaaattataatacccgtgaagatgcgggttacccgcgacaggacggaaagaccccatggagctttactgtagcttgatattgagtatttgttaaacatgtacaggataggtaggagccagagaaagtaggacgctagtcttaccggaggcaatgttgggatactacccttgtttgatggatcctctaactcacagagctgagcgttctggaggacagtgtcaggtgggcagtttgactggggcggtcgcctcctaaagtgtaacggaggcgcccaaaggttccctcagaatggttggaaatcattcgcagagtgtaaaggtataagggagcttgactgcgagagctacaactcgagcagggacgaaagtcgggcttagtgatctggtggtactgcatggaaaggccatcactcaacggataaaagctaccctggggataacaggcttatctcccccaagagttcacatcgacggggaggtttggcacctcgatgtcggctcgtcgcatcctggggctgaagtcggtcccaagggttgggctgttcgcccattaaagcggcacgcgagctgggttcagaacgtcgtgagacagttcggtccctatccgtcgtgggcgtaggaaatttgagaggagctgtccttagtacgagaggaccgggatggacataccgctggtgtaccagttgtcttgccaaaggcatcgctgggtagctatgtatggaagggataagcgctgaaagcatctaagtgcgaagcccccctcaagatgagatttccgatgcgaaagcagtaagacaccttaaagacgatgaggtagataggctaggagtggaagcatagcgatatgtggagcggactagtactaatcagtcgagcacttgaccaaagctcaaaggtttaaaggctagagattatattcagttttgagtgtaaaagctcagaaagagtacggtggcgatggcaagaaggatacacctgttcccatgccgaacacagaagttaagcttcttaacgccgagagtagttggtgggaaactgcctgcgagggtaggcagtcgccgtgctcttttttaatattccggcttagctcagttggtagagcacctgactgttaatcaggttgtcgtcagttcgagtctgacagccggagtttatggcaataataaaataatggagtgttgtccgagtggctgaaggagcatgattggaaatcatgtatacgggctttacctgtatcgagagttcgaatctctcacactccgttggagaatatttttcgccataatatgtatttcatttattgagtaaattttttgaaaaaagtacttgctttttgaaaaagatctggtatagtaatatatgtgctcaattgtgagatctggcccgttggtcaagcggttaagacaccgccctttcacggcggtaacatgagttcaaatctcgtacgggtcattgccatattaaatatggttgttggaggattagctcagctgggagagcatctgccttacaagcaggaggtcacaggttcgagccctgtatcctccatcgttcacgggactaccaaatatggtagtccttttttgtgtttaaagacaaatgagcgaatttttattgtatatattgttattcggttaaggtcccgaaaggattcgtttttaacgaagatgccttgtaaccgaaagatgggggactctatgaaaaaagaaaaacgtttatttacttcggaatcagtttcagaaggacatccagataaagttgcagatcaaatttctgatgctattttagatgcaattttagctaaggatccagatggtcgtgtggcttgtgaaactactgttactactggtctcgttttagttgtaggtgaaatttcaacctctgcgtatgtggatattcaatctgtagttagaaaaactattttagagattggatacaatcgtcctgaacttggttttgacggtaataattgtgctatcttagtcgatattgatgaacaatctagtgatatcgctgatggtgttaatgaatcacttgaaacacgtgaaaaccagcaggacaaagatgatttagataaaataggtgctggtgaccaagggttaatgtttggttttgccattaaggaaactcctgaattaatgccgctacctatttctttagctcattcattgatgagacgggttgctagtcttcgcaaagagggacgtcttgattggctaagacctgatgcaaaagcacaagtaactgtagaatacgatgatgaaaataaaccaaaacgtatagatacagtggttatttctactcaaactgatgcaacagtaagtaacgatgaaattcgtgaagcaatgatcgatatggtaattaagaaggtcataccatctcaatatcttgataaggatactaagttcttgattaatccttctggtcgctttgttattggtggacctaaaggagattcggggctaactggacgtaagattattgttgatacatatggtggatacgctcgtcatggtgggggtgctttctcaggtaaagatttaactaaggttgatcgaagcgcaagttatgcggctcgatatgtagctaagaatattgtggcagctggcttagcttatcaatgtgaaattcaacttgcttatgcaattggagttgcccatccagtttcaatcatggttgatacgcatggaacaagtaaagtaagtgaagatctattggtagaggcggttagaaatgtctttgatttaagaccagctggtattatcgaaatgctgaacttaaagcgtcctatttatcgccaaactgccgcttatggtcattttggacgaacagacgtggatttaccttgggagcatacagataaggtagaagcgctaaaaacatatgtgagcgagcatgcagaataaaagtaatactaaaattgtaacaattgctatctttttaacgacctttatgacagcgattgaagggactattgtatcaacggcgatgcccacaattgtttctgatttaaatggattagaaatcatgaattgggttgtttccatctttctattaatgactgctgtctcaaccccaatttatggaaaactagctgatagccttggaagaaaacctgtatttctattcggaattgctgtttttgtgattggatcagcactttgtggaattgcacagaatatggtggaactaatcctctttcgagtaattcaggggcttggatcaggagcagtacagccagtagctgttaccatcattgctgatttatatacgcttgaaaaaagagcaaagatgctaggtttaaactctggtttttggggagtagcttcggttattgcaccattgttaggtggattcattgttcaacatttatcatggcactggattttttatattaatgttccattaggaattttagcctttttactggtaatcatctttttgaaagaaacaaagacaagtaaggattccactttagatttaaaaggaacaacttgtttagtcatctttttattggccttaatggtcttcttacaagaaatagaaaatggctttaatttaatcttattgggattactaattattattgttgcttcagccatccttttctttcggatggagaagaaagcaaaagatccaattatgccactagatatgctaactagcaaagaatttacaatgattaatttgattactttgcttatttcaggggtagtcattggctttgaattctatattccaacttggatgcaaggaataaaggggacaagcgcttctgttgctggatttgcggtgacaccaagttcgttaatgtggattgtaggatcatttttaattggtggaatgcttggacgatggggaataaagaaaacatatgattatatgttaattgtccttattggagccgatttagccttaatatttgttcccatctatacctcattttgggtattttgtctgattgcagcattcaatgggacagcctttggagctattacaactgcttcgcaagttcgttctcaagttttagtaggacgcgataaaattggagttgcaactagttttaatacattgatgaaatatttagggcagactatgatggtctctatatatggaattacatttaacatggttgtagcaaagcagttaacacatcatccgcaattaactcaaagaatgatgaatgatattgtttctgctgataaagctaaacatttagcacctaatttaatccccgctttaagagaagttttattaagcggcttaaagtcggtatatgtggtttctttaattgtgataattttatcgttagttcttaatcaactttataaacagaagaaaattgttgaataaaaaatgctaactgagtttaacattatactcagttagcattttttatttattcttttttaaatagaggtggtataaaacggaaaatccaagtaaaacaaatgttgtaccttctagccatccaccaattacgtctgagggatagtggacatgacagaagatcctagtgtaaccaataaaaagtgggaaaatactccaaataataattaaaatagtgcgccaggatttattttttactaaaaggatagttaagactattagaataccaaagaaagttgcactacctactgagtggcccgatggaaagctataaccatcagcaaaaactaaatggtgaactaaggggcgatgacgttcaacggcatgtttggtaatccaattataactattggcacagatcattaagccggctgagaagaaagcataggcgaatcttttggcaatcagcaagcaaataaataaaattatcgtagcaatggttaaagtactagtattaccaattactgttaatttagtggcaatcgctacattagtaggattgttgttagaaagtagatgaataatagtttggtcaaaagaatgtatgaaaggatttttataaatgaccaagagtgcccaaattacataaagaattaaaaaaataaatccaggaataagggtatcgtggatagttaaattgttatatttctttttcaaaaaaatttctccccttgtaatttctagtagatgtggtaaattataatcattatccatcaaaaaataaaggctagggagtagtaacaagtcagagttgttattagagatgagctggttggtgtaaagcttaacaatgatgctgtgaacttgccctaacgacaggtctatcgtttgccttccgcgttaaggggcacgagtgtcacacattgaatgtgtggaacttaggtggtaacgcgaaattaacttcgtcctatgattttaatcatagggcgtttttttagttttaaggagagatatttttgtataatcacaaaactgtagaaaaaaagtggcaaaaatactgggctgagcatgatacttttaagacaggcactgatcctaagaaaaagaattattatgctttagatatgttcccatttccatctggtaaaggtcttcatgtaggacacccagaaggatatactgcaactgatattgtttcaagaatgaagagagcccaaggctataatgttcttcatccaatgggctgggatgcatttggtcttccaactgaacaatatgccttaaagactggtgaagacccagaaaaagttactaaagaaaatattgctaattttaaaaagcaactgaataagcttggtttttcgtatgattgggaccgcgaagttactacttctgatccaaattactataagtggactcaatgggtttttgaacaaatgtataagaagggcttggcatatgaagctgaagttcctgttaactggtctccagatctaggcacagttgttgcaaatgaagagattattgatggtaaaactgaacgtggtggttatccagtttaccgtcgtaatatgcgtcaatggatgcttaagatgacagcttatgctgatcgcttgctcgaagatttagatgatttagattggccagagccagttaaagaaatgcaaagaaactggattggtcgctcagaaggagctcaagttacttttaaggttaaagatagtgataaaacatttgatgtgtttactacacgtcctgataccttatttggtgttagttacactgtcttagctcctgaaagtaagttagttcaagaaattacaactcctgaacaaaaagaagctgtggatgcttacattaagaaaattgaatcaaagtctgatctagaaagaactgatctaaataaagacaagaccggtgtctttactggtgcctatgcagttaatccagtaaatggaaaagaagttccaatttggatttctgattatgttttagcaagttatggtactggtgcagtaatggcggtaccagctcatgatgatcgtgactatgcttttgcaactaaatttggcttgccgatcaatcgagttattgaaggtggaaatttagaaaaagaagcctttggtggagatggtaaacacatcaattctgaattcttagatggtttaaacaatgaagaagctaagaagagaatgattgagtggcttgaagatcacaatgtaggtgaaaagaaggttaattataaacttcgtgactgggactttagtcgtcaacgttactggggtgaaccaattcctgtaattcactgggaagatggtactacttcactagttccagaagatgaattaccattacgtttgccacatgcaactgacattaagccatcaggtactccagaaagtccacttgccaatttgactgattgggtaaacgttgttgatgaaaacggtcgaaaaggtaagcgtgaaactaatactatgcctaactgggcaggttcaagttggtactacttacgctatattgatccacataacgataaagaattggctgactatgatttacttaagaagtggctccctgtagatctttacattggtggggcagaacacgctgttcgtcacttactctatgctagattttggcacaaggttctttatgacttgggtgttgtaccaactaaagagccattccaaaagctttataatcaaggtttgattttaaagaatcatgaaaagatgtctaagtctaaaggaaatgttgttaaccctgatgaagtaatcgatgaatatggtgcagattcacttagaatgtacgaaatgttcatgggtccattagatgcttcaattgattgggatgataatggtcctgcatctactaagaaattcttagatcgtgtatggcgcttatttgttaacgatcttgacctaaaggcaattcctcaagaaaagattgttgacgaaaatgatggtgaacttgataaggtatatgccgagactgtcaaaaaggttacagaagactttgaagctttacactttaatactgcaattagtcaaatgatggtctttatgaatgcagctcaaaaagctaagactattccacgtgaatatgcagaaggatttgtacaacttcttgctcctgttgcacctcacatgatggaagaaatctggtcagtatttggtcatgatgaatctattgcatatgcgaaatggccagaatatgatcctgcaaaattagttgaatcaacagttgaaattatggttcaagttaatggtaagcttcgcggcaaatttaaggctgctaaggatagtgataaagataccttagaaaaagaagctcttgctcttgatcatgttcaaaaattcttagaaggaaaagatgtcaagaaagtcatcgttattccaaacaaaattgttaatattgttgctaagtaatttaagtttttcctaaataattaatatttgtaaatacaatttacattaatgagtaatatataattcagacgcttaactggatatagggaaaatttatctttatggaaaacaatactaaaaatactaaagagacaatggtcaaaggctccgcatggatgacttttggctctattgtgtcacgaattttaggagcattgtatattattccatggtatgcctggatgggaagtcatgggaacattgccaatgctttaacagcgaaaagctataacatttatagtttatttattattatttctaccgccggtattcctggagcggttgccaagcaggtggcgaaatataatgctttaaatgaatatgatattgggcgaaaactatttagacgcggcttaattttgatggccatgtttggtgtgatttgtgcagcaattatgtattttggtgctccaattttagctactgatgatatcattggtgcacttttgcatggggctaaaagtgatccacgtcaagttgccgtgatgagaagtctttcttatgcagttttaattattccaattttgagtatcatgcgtgggtatttccaaggttatgcagatatgatgcctccagctatgtctcaatttattgaacaattggcccgagtgatatggatgctattgacagcttatattattatgcaagttcaacacggatcctatgttcatgcggttgttcaatcaaatttagctgcagctattggtgcggtgtttggaattttgctcttagtatggtttttatatcgtaggcgaaatgaactgaacgtattaatggagcaatcaaaccacgtaattaaaatttctactgcaggaattttctgggaaattattaatcaatctattccatttatcatcattgattctggaatcaccttgtttcaattaattgaccaatataccttccatccaatgattgctatgtttgttcatgctagttctgatcaaattgaatcatggtatgcattgtttggattaaatgcaaataaattaatcatgattattgtatctttagcaactgcaatgtcagtaactgctattccgcttttatcaggtgcccatgcacgacgtgattatgccagcatttctaaccaaattgaaaacaccttggaattattcttatttgttatgattccagcttcattggggatggctgctattgcaacgccaatttatacaattttttatagctacgatcaactaggttcaaatgtcttgtacttatcatcatttacggcaattagtttaggactatttacagttttgatggcaattttacaaggtctatcagagaacggactagctataaaatacctagttttaggaattatcattaaatttgctgttcaacttccaatgattgaattctttaaagtatatggaccgcttctagctacaaatgttggattaattattactatctggctgtctttaaaacacttaaaagttagatacaaatacaatagtagtcgtacatcgagacgatttattggaattgcaatcttttcaatggccatgtttgtgatagttaccggggtagttaatttcggtggaaaaattatttcgcctgaacgtaggccaacctcatttgttcttgttacacttgcggtagttattggcggcttactctatgcctttttaacagtgaaatttggtttagctcaaaagataattggaccaaaagttgatagggtcttagaaaaattacatattaaagtttaaaagagaaaaaggaaacttgagtaagatacttacctaagtttccttttttgcccctgccaaggaagtctattatataatattttcggagaaagtgaggaagaaaaaagtggataacatgcttgtatatgctgcaaaagagaagcgaagttttaatgaatttcccttaaatgaagtagatagtatgattttttctcaattagcgtattgtaattttgatactcttcctcagcatcatagtttacaaagtttggcttctgatgacgagattaagactttaactcaagggaatctcggtggaaagaatactgaaaagttaatcaagattatgctagaaaatccccgctttaaaaaactatgttggcgcaatgtggttagtaaagtagatgcaaaaacacaaatgcaatttaatgctgttacattttgtattgcagaagatcaatactatattgcatatcggggaacaacggctactaccatcggttggaaagaaaattttaatatgtcttttaatgattgggtaccagctcattactttgctcgttcttattatcgaaaaatcaaaaatttgttttcagggaaattttatcttggtgggcattcaaagggcggaaatttagcttttgccgttgcattgaacctaaaagaatccgacctgtcacatattgctagaatcgactgctttgatggaccaggttttcataatcaagaacgattaaagaatagattcttgaagttaaagggtaagattcataaatatattccgcaaggttcattgattgggatattacaagatgatctgattggagaaaaagattattgtactattgtggcagcttctggaaatagtttgctccagcatgatatgtttacttggcatgttatcgatgatcaatttgcaaccgtaaagcaattagatagcacatctgaagtttcatggaaggcaattgctgaatggctaaaaaatacaaacgatacggaaagaaaagattttattgaaatgctctatctaacggtgagtgacactaatcaaatttatttcagaaaactgttaacgcctaagacgacatataaattagctactcgtttgataaaaaacagttctacccaaaagaatgtttgggaaccaataataagaaaactttttaaagcctatgtgaattcaggagcagcagcttttagtgaacaaagaaaaaatcaattatcaaactttaaaagaattttagatgaacaacgcaataaataggttaagttataaaaatctatcttgaattaaaaactacctgcttatctagaaaaagagtaaaataacgattgaaagaggtggacaaaattgaaaaaagatacatatatgactttactaggattccgtgatacttgttataatgatttcaattttgatattgatgagaaagatttttatttaggaactgatacctataaaaaaattgacaagatattaaaggatgcacagaatgaacaattattagttcagtttgaagagggtacttatctttatcaagattatgatccagaatacttgagcgtagcacaaaagagagaaattcaacatgatattaatgcagctcgtaactttttggataattacgacggggatgtagacgataagcatgataactatgcagcttacctagatgataattctttgagttattcttttggtccagatagtaatttagatgaagtacaaaataatttaaatgatattgaaaccaatggcgtaatcatttggcaaagacgaaaagatgaatatattttattaccacataccattcatagccttgaaagaattaaaaaacagattgcatcaagtaaacgtgtcgatgataaaaaattgcgttatgcaatggagcgcttatttgacaatataactgattttcttaagccatttagtgatagtgaattaggaaaatacgaaaatacaatttcacaggagcttagagataatttggaacattatgctttaagtgttcaaactgatgcacgtgaagtagctgcagataaattaactaaatatgcagtgcaacttgcagaaaaagaaaataatgacagtatttaaagtaaagctcatcgattagatgagcttttttggataggacaaaatgaaatctatttcaaaagaattaatatctacagtaataaagaaaagaaaaagtgctacccataaaggtaattatggccgcttactcctaattggaggtagtaaaaaatatggtggagcactgattatggcagcagaaggcgcactaaacagtggtgcaggcttagtgacagttgctacagaccgagtcaatattgccgctttacatactagagacccagagattatgactcttaattgggatgaaagcatagaattaaaaaatttaattaaaaactctgatgtagtagtttgtggaatgggtcttggattagatgataaagcacaacaaattttaaggctagttagagataatatcaccttaaagcaaacactaatcttagatgctagtgcactagatttaattggtcagcaaacggatttactaccattaaattcaaaaattttgatttttactcctcatcaaatggaatgggagcgattaagtggaataaaaatttctgatcaaagtgatgaactaaatcaagtagctttagataaattagttaaaaataagaatgcgattttggttttgaaatccaatcacactaaagtttatgatcaagcagggcatatttatttaaatccttttggtaatccaggaatggctattggtggtatgggagatacattagctggaattattggtggattttgtggtcaatttatacctaacttagaaacagtggcagctgctgtggggattcattctttaactgctgataaaattgcagagaggcaatatattgttcgaccaactcaattatcggctcatcttccagagataatgaagcaatatgagaaataattaagtaatgacgaaataagttaaattgcataaagagaaattgggtgaccgaatgagacatgcaaagaagaaatctaggaaaaagtatttatggttaattagccttgtaatagcagctatttgtttttttgtatggaaaaacaattttaactcaaatagaatgccagctaattatcatgctgaccaagtagatttaaacgttaaagctgccgtagcaattaatgcaaaagatggatcaaccatttacgctaaaaatgctaatcaaagcttgccgattgcctcaatgaccaagcttttaaccgtttacttaactctccaagcaattaaagagaaaaagatatcttgggacacaacggttactccgactcaagaaatagttgacttgggctcaaatccagattacgcaagtgttccacttaggctaggacaaaaatataccgtcagagaactatacgatgcggctttaataaagtcggcaaataatgcagctcgtttactcgcgattgcagttagtggaagcgagacaaattttctaaatcaaatgcgccagcaagctcgtaaatggaaactcaataatgctaaattcgtaactgttgatggtttaccagagaaaaagaaaaattttttagggatgacgacaacagttgaaaataaaatgagtgccaatgatatggcgattgtagcaagaaaattaataactaattatcctgaaattctaaatactacgaaactagctagagcatattttcaaaatactcttatgactaatagtaataaaatgttaaacggtctctcatactatgattcgacatttcctgttgatggtttaaagacaggtactactgatggcgctggttcatgttttacttgtacagtgaataaaaatggaaaaagagtgattacagtaattttaggtgctgaaaatgataatgaacggtttgtggagacaaaaaagttattaagttactgttttaattaaaattttactatgcattagatttaatattgcactttccctaagtttgctgatataatcttcatgacaaaaggttaaaagtagtagtattgcatatgttttcagcgagtctatgtttggtggaagttagacaatggggcaatatgaaggcgtgtttaactttaactttaaaatcaattaataagcggatactttgtatcaagtagagtggtaccgcgggaactttctcgtctctttctagtttactaggaagagactttttttatgcaagaggtgttataagtggattttaaacaaaaagtcgttgatttagttagtgaacaggtagatttacctaaagaaaaaatttctatgttaattgaaagaccaaagaatcctaagatgggtgattatgcttttccagcatttgctttggctaaaattgaacataaaaatcctgctttaattgctaaggatattgcagaaaaaattagtgatgataatttcaccagtattcaagcagttggaccatatgtaaacttcgcaattgatcatgcaaaattagtcaatgcaactttaaacgatgttctaactgaaaaagaacattttggtgatcagaagcttggtgaaggaaatgttccaattgacatgtcctctcctaatattgctaagccaatgtcaatgggacacttacgttccacagtaattggtaattcaattgctaagactttagaaaaagttggatatactccaattaaaattaattatcttggggactatggtacccaatttggtaaattaattactgcttatcgtttatggggtaatgagggagatgttaagaaagatccgatcacaaatcttttccattactatgttaagttccatgaagaagctgaaaaagatcctaaattagaagatgaaggacgtgctgcctttaagaaactagaaaacggtgatgaagaagaaatcaaattgtggaaatggttccgtgaagtttccttacaagaatttaaccgtatctataaagaattaggagtaacttttgattcatataacggagaagcatttttcaatgataagatgcagccagtggttgatgaattaagagaaaagggcttacttgaagaatctcgtggagctcaagttgttaacttgggagaagatgaaaacccagctttaattttaaaatctgatggctctagtctttatatgactcgtgatttggctgctgccttatatcgtaaaaaagaatatgattttgttatgtcattatatgttgctggtggtgaacaaactggtcactttaagcaattaaaacaagttttgaagaagatggggtatgactggtcagataacattcaccacattccatttggtttgattactcaaggtggaaagaaattatctactcgaaaaggaaacgttgttttcttagatcaagtcctaaaagatgcagtttctttagcggaacaacaaattgaagaaaagaatccaaatctatctaataagaagcaggttgctcatgatgttggtgtaggggccgttgtattccatgacctaaagaatgatagaatggataactttgattttgatttggaagaagttgttcgttttgaaggggatactggtccatacgttcaatacactaatgctagagctcaaagtattttacgcaaagctaataaagagatctcaatggataatttaagcttaaatgatgattggtcctttgcagtcgcaaaagcattagctgatttccctgctattgtagaaaaagcttcagaaaaatttgaaccatcaattattgcaaaatatgccttagatttaagtaagaaatttaataagtattatgcaaatgttagaattttagatgaagataatcaactaaacgctcgtcttgcattagttcaagcaacttcaattgttttaactgaagctttaagacttttgggtgtaaatgcacctaaagaaatgtaatatttctttaaataaaaatattcactgaatttttttgagctaaagtatgttaatttttgcactaatgggttaaactagtgatgtgttaaaaatttaggaggtatttttttaatggcttatttagtaaatggtaatgacattttcaaagctgctcgtgaaaaccactacgctgtaggtgcatacaacactaacaaccttgaatggactcgcgcacttttaagaggtgctaaggaaactagaactcctttattgattcaagtttctactggtgctgctaagtacatgggtggttacaagactgttaaggacttagttcttaacgaaatggacaacatggatatcgatgttccagttattttgaacttggaccacggtgactttgaatcagctaaggaatgtattgcacttggttactcatcagttatgtttgatggtcacaacttaccaactgacgaaaacttagcaaagactaaggaaatcgttaagttagctcacgaaagaggtatctctgttgaagctgaaatcggtaagattggtgaaaaccaaggtgccgatggtggtgaattagcatcagttgaagacgctaagactttcgttgctgctggtgttgacaagcttgcttgtggtattggtaacattcacggtgtttacccagaaggttggactggcttaaacttcgatcgtttgaaggaaattgcagaagcagttccaaacgaaccacttgttcttcacggtggttcaggaattcctcaagaccaaatcgaaaaggcaattcaattaggtattgctaagattaacatcaacactgaattccaattagcattccaagctgcaactcgtaagtacatcgaagacaagatggacttagacaagggcaacaagggttacgatccacgtaagcttttgagagctggtactgacgcaattactgattctatgaaggaaatgatttcatggatgggtactgcaccaatcgacacaaaggaatcatcagttcaatttgatgaagcttcattaaacgaagaataatcaaaaactatattaaaaaagacctcagaaattgaggtctttttttattagcttaagtgtggaaaaatgcaagtaatatttgatgatcgtggatgtaaaagcttttttaaaaaatataataggcaaaaaaagataatcaaggatctaattgaaaaagccattgttaaagaagttaccactgggatgacaaagattaaattggctagtagaaaaagaattaagggacaaaaaatttatgaatttcgattaaatcttggtactattggatcggctcgaattgccttttcagtttttaaagatcaggctactatttatttcattagtaaggatatagaaaaagcatcttttagtaaggcatttgaaaaaattttaagataatacagggtagccatgatatacaagtatagtaaataatatcgttttcaaaaaatagttatcaaagaaatcaaaagtaaagcaaaaaccctcgttgacttagatcaacgagggttttttaatactaaattgtagaggaaaatgaagaatgaattatggatttatttcctacgaacctttacaggaactggaactggtttatttataattactgcgttagtagcaagtactgcgacagcactaatacctaaaattaataatagtgtcatttaaaccattcctttcttacttgattgatatcaatattaagagtaatttgtgaattttttgtgacttatatttaagataaaatctaaaaaaatataaataatttttctttatttataaaatacgaacaatataattattagtagtaaaaataattaataaataagtgtaaaaagactaaaaaaatcatcggatttatgttagaatttcatcattgacgattttaataaagaggaattaaagaatgaataacgatatcgaaagtgtattgtatactcaaaatgatttaaacaatcgtatggatgaaatggctgctgaattaaataaaaaatataaaaatgaagagccaattatcgttccagtcttaaatggagcaatgatttttgctagtgatatgattaagcgattaagttttaagctaacgattgatcctatcaaggcatctagttatgaaggaagccactcaacaggaaaagtaaagattacgcaagatattaagtcagatgtaaagaatcgtccagtaatttttatggaagatattattgatacgggacgtactttacaagcgcttagtgaaataatgaaagaacgtggggctaaaagcgtagaagttgtatctatgcttgataagcctgaaacccgtgtcgtagattttcatgtagattattatggttttaaggctcctgatgagtttttagttggttatggattagattacaatggcttgtatagaaatttaccttatgtaggaattttaaagcatgaagtttatgctagttaaagggataaataatgcgcgttaatgtattgcaacatactccaaacgaggggccaggagcaattaaaacctgggcagatagtcatcatcatgaattatatgtgtatcaccctgaaatttttggtaaattgccaactgctaatgaaacagatctactcgtaattctaggtggccccatgagtccaaatgataatctagaatggattaagcaagagagagttctaattaaaagaatgcttgatgccggtaagccgatgtttggtgcttgtcttggcgcacaacaaatcgcaatgactaccggagctaaaattttagatgctcctcataaagaagtaggctgggctccagtttatttaaaagatacaacactaccggatattcctaaagaactaacggcccttcattggcaccaacaaatgtttgaaattcctgtaggtgcaaaacttttattttcgagtgacttcgtagagaatcagggctttttattaggagataatgttatcggcttacagtttcattttgagcctgaagaagataacgttcgagaaattgccattaacgatagtgagtatccacttgaaaataatgatttaaatcagactgctgaagaaatcattgctcatggtgtaccgagagaaaataaagaggtaatgtttaaattactcgattttattactaaaaaatgagtgtaaattttggactactaataaaaagtaagctatcataaagctgtaagttttttcgaggaggaaaaattatggctaaaatatttatttttggtggttccggaagagtagctacagatttaattaaagatttagtagctgatggtaatacagtgacagcagcagctcgtcatccagaaaatattattaaacttgatggtgtaacacctgataagcttgatttacatgctgatgtagaagatattgctaaacaagtaaaaggttttgatgctatttactttacggctggatctcgtggtaaggaccttatccaaactgatgctatgggagcaattaaaactatgatggctgctgaaaaagcaggtgttaaacgctatattatgctcagttcaatgcttagtttagatgtagactcttggaagaagattccaggtcttgaggactatctagctgctaaattctttgctgatacttatttaatggattcaactaatcttgaatatacaattttgcagcctacgaatctcactgaagaagccggaacaggcaaaatcaaacttgatgctggtccaagtgactcaaatccaattcctgatgttgctaaaacattggctgagattctaaaatatccaaatactattgataaggttattccaatgagtagtggaaacataccaattgatcaagcattgaaagaaatctaactagaagaaaaagctccattgtggagcttttttgtgtttatagtggtcaactaccctagaatgaattctggggcttggtggttcgttagcttgcgctaactatttcaccaatttgcttagatacaggcttaacttgtttgaattgcgaaaatccaaacagcggttttcccaattaccaaagccttttgagtctgcaagttgccaaacggactgcagtctatttagatcgcttttttattttaggatttttccaaatacctttgcttttttctaagatgtttacagaagcattccaatctcttatgtgataacttccgcatactgggcaagtccattttcgatccttaagcgtaagtttcttatagccgttttgtcccattatgtttccgcaattatgacacctttgcgtagtaaattttgggtcaatcgtgacaaactttttgccatgaagatcagctttatattcgagcatggttaagaaactccgccatcctgcatcagaaatagattgggcaagagcatgattctttaacagatttttacttcttagttcttcggctactactaaatcgtggtttttgattaatgcagtagaaagaacctgcaagaagtcttgtctctgtctgcgaatcctgtcgtgcagtttagctacggctaggcgctgtttttgatagttcttggattcacacaaagagcgtccttcttttttggctctgcgttctctacgtgaaagtattctttgagcgtgggcgagctttttcttggctctgcgataaaaccttggattagctaccattgcaccgttagaatccgtcaagaaattatccaagttaagatcaatgccgatctgcttttgtgttttagcatagtctttgacaaaggcaatatcacttcccagctgtaaagaaagataaaactgatcgtctgccgttttcttaattgaggcagtaccgattcgaataggaatacggttaaacaaacgctttttaatcagcttgcgcaatccagcaattctcactattcccagtttaggaagcttaacatgcttagcgtcaataaatctaaccgtaccattatcaagataggctgcgtcttgctttatgtactgacagttagtctgatatgaccagctgcttcgtttcttgtgaaaggttggtattccatagccaattttatgatagtttctccatgctttgtgataattttgaattgcattggcgatagccaagctatcaatgtcttcaacacgcaagaaatcatatttatctctaatatttttaggtttggaaattaagtcttgcgtatcaatcattcttaatgcctgttgattttcatattcagacattccctgcattacaaagggcaaaccgctgctaagctgtttgatcctattggcctttttaacgtgatagatcaaacggccagcgccaacgtattggttataaacaaaacgctgtgcgtcataattctgcttaatcattttcttttgattattgctaggatagaatcttacttttacgccaaagtgatattctaaactgctcattcttttcattttttcacccccttttattgatatgatttgattatagactatgtagatattataatcaatagtaaacacttataaacaaagaggttagcaatattctctatgataaaaaagaaagacaaaataaaagacgcaggctatgaaaagcactacgtctacaatactcattatcatttgatttggtgtaccaaataccgcaatcaaatttttacaaataccaatttagccgaagaaatgcgaaagcttttattgcagattgccgaggataatcaaattaagatagaaaaaatggagatcatgcccgaacatgttcacttattggttagctttaagccctctaaatctggttctagtgtaatcaaggctctaaaaggtagaagtggcaggttgtttttgcaggcacatcccgaaattaggcaaaacaagatgtggggcggacatctatggtcgccaagctattattttggcagtgtaggcaatatgtccaaagaagtggtagagaaatacatcaacgatcaagtctataacgcaatcaaagacggtaagccctatccatccccgcattaaaatacggggatttacgggcggatttcattaaaaaagtgatttttagaatttaaacaccttagaaattttttctaaatatttttgatctaactcatcgaagttagctaatttagttgaatcaaaatcaaaaactccccataaatcgccgtttgctttaaagatagggacaacaatttcagaatttgattcactatcgcaggcaatatgtccagcaaactcatgtacattttttacaatttgagtttgcttttcttttgcggctgttccgcatacccctttaccaatttgaatatgaacacaagctggttttccttggaaaggaccaagaattaattcttgattctcataacgatatacaccagcaaagttaacattattaagtgaattgaacaataaagctgaaatatttgctgtatttgcaatccaatcgttttcgccttcgactaaggcttgggcttgttttaataataattgataattgtcttctgtagtggcagccataattgaataccttctttctgttaaattgttctaattataacattaatttagtaaattaaggattttaagccaatttttttcagaagaaacttatgtatcaccataactatataggcagtaataaaaataagtggagctaaagaaattggtaataaaaaaattaacaagatagcggtaaggagtggcttttctaaaataatagtgatgctagcaactactgctaacgagacagtaattgcgggctgaatagggatgaattgagcaattgcagcaccaacagcgacactagcaaaaattgctggaaaaattttacccccacgccatcccattgcaaatccaacatgggtagaaattgtttttattagagcaattaatagtaaaaataatggcgaataggaaagagcagttttagaaaatggaacaatgtgaaattcgcctgaaaagagtgcgtaatcagttactaaagttaaaacgcttagcacaatgccccataaggttgcttttaaaagtgctggtaaggcccaagtctctactctagtaaatattttttctaaatataagaagaaatatgcaaaaagcatcccacctataagaggaattagactataccagagaatagtccatgaccagtgaattggacgttcatgaattccgaatgctccttcttcaggaaaaagtttaaagatcaaaattgttccaattaatccaattaaaatattaaaagtgatgaaccattttttttgatttttagttctaaaaagctcactaaactttggggattgcaatagagtatctttatcaatgcctatttgccaaacatgaacccagcttttgtaatgagtagtcatcaatctaattttatctccgagccaatttatcatcccggaagtaagaacagtggtggaagcttctggcccaatacttccgccagctcctaatgataaaagccctaaagtaaaagatttccaccaagaatgataatcaagttttccactttttcgcacatcatgtagtacttcttcaatcgttaaaggataggaacctaatttctttactaagaaaccaataattattccaaatgatatacaaataagaaagggataagcgggacgcaaagaaaaattactatgatgattaaagtaaccccaaataaagtcaataacataattgattaggttgagatataaagcagttaaaataccaataataaaactccatatgccactaaaaattagaatatttatgctttttttagccattattttctatcaattcctttatgcaatttagattcatgatagcagtgtactttatttgttgtcttggttcaaatcgctcataataaatttgggagcagaataaataaagaaaggattggtccatttatgattggaagagaaactcaaatatgcctagtaaataaattagagaatattcaccatgttgtagttcaagcttccgcaattgatggaagtaacgtctttgccttgcagcttcttcataaacaaagcgacgttgttgtttatcaaactccaaatgatagcgaaactgttacatttgatgaagaccatcctattttatacttaaaaggtccaaattcagctggaactgctggtggacatacccagacctggatacaaagtggagaaaataataaatggtttgttggtactaaacccaaaagacagggaaatacatattggaccacacaaattgcaagagtaacagtaccggggtatcaaacacaggtatttgctaataatactgatttaccacgtctttcctatcttaaccgagcaggagctggttatggggatggaggtacagtttatccaggaaaagatttagtaagagtagaggccactgtttcaccaaatggtcattatttcttgattgcaagtattgatataaatcatacgggctattttgcgctttatgaccttaacgaagtaaataacaaattagatgaggcagaagaaaaagctgaagatattaatattgaaaacttaacatgcttaggagcatttaaggttcctcattttaatgatcaaaagattgtctctattcagggatacggaatagatgataataaggatatctatatttcaagtcaaccaagtcctcatacaacttttttgggttttccaagacagggaaggcctcgtgaaattgttaaaattccgtggggaatggttgatcccgataaatggtctgtagttaatttagataacagcttaaaacttgatgcgttagatttttgtactgaatttgaggggattcaagtaactagtgactgtctttacttaacagtagcttatcaccagcgcaacagtgacttaacaactctaatgaatcgtatctaccaagttgaaaaattttagaatgaaaaatagacagacttttatgtctgtctattttgctataattgataaaaatgaggtgtgagaaatggaaaaaatgcgttgtagttggggaaatagtaagaatccgcgctataaaaaataccatgatgaagagtggggaaagttgaatctagatgccacttacttatatgaaatgcttgtattagaaagttttcaatcgggattatcctgggaaacaattttaaataaacgtgaaaattttcgaaaagcatttgcaaattttgactatcataaagtagcaaaatttaatgaagctgattttgaaaaattgatgcaagacaaaggaattatccgtaatcgactaaagattaatgctgcaattaataatgcaaaagttttagttaaactagaaaacaacaatcaaactttcaaacaaattttaactaagtttattcctgaaacaataaatcaccatcctaaaaaaatggaagatgttcctgcttcaaatgaattatctaaccaaatttcaaaagaaatgaaaaatctcggatttaaatttgttggttcaataacgatatattcatttttacaggcagttggattaataaatgatcatatagaaaattgtagttttaagaatggagaactgtaatgcctttactactaccgacaaaacaagtggtgattatgtttattttaatgtttattggctggatttgctatcaggtaaaatttctccatgaacaaacagtaaaagatttaactaagatacttctttatgtggtatcgccatgcttaattattaattcttttcgccaatctttttcagttactagattaatacaatttagcttaatttttttgctggtacttgttttatttgtgtttaaaattattgtaagctcagttctctttaacaaaagaataattaaagacgagcaaaaaagaacaattctccgatatgctggaacttacactaacgcaggttttatgggaattcctttagtacaagcgcttttaggaaataatggtgtgtttttcgcagtaccatatttgattatttataacgtctttatgtggacgcatgggattaggatgtttactagaaaaaagcaatcatttaaagaaagttttcatcaagctatagttaaccctaatatcattgcagctattgtagggatgatattatttgtaattcaaattaaattacctgatatagtttctgaccctatgaattatattgctaatttgaatactccgctaagtatgattgttattggtacaaatcttggagctattaatttaaaagaagactggcatgataaattagtttggagtggggtattagttagaaacctctttttcccattaataattttaggcttcttactaattttgccacttccatcaattgctaaaatgacaactttaattatggcagcttgtccggtagcaggagtagtagtgctttttagcttaatcagtaattttgaagtaaaatttcctactaaattaatgtgtttatctactttagtagccattattaccattccagtcataattagtctggctaatttaatgggaatatagggggaaaatggaaaaatgaaagaaaagaagaagaactatttagcaatcaataaaactggtgtatcaattaagtggctcacaatagcctcactagtctatctgttaatctatactgaagctggtgatatagtaacggcattttctgaactttgggccccaatattgtatttagtgattgtttgctttttagcactgggagcaaaaatattttataaaacagatcgtgtttttattaagttacctaaagagggtaaagtcaatatcttaaccattatcttttgtattatgttaatggctttatactttttaatgaatttgattgcaagctgggcacaagtctttaatttaatgcctgaaatgatgtggtcttctatttgtgttgctttagccgctggaattggagaggaatttctttgtcgtgtaactttgtttaatttatttaccaagatttttgaaaataaacagtacgttttgctttggtcgagcattttttcttcagttttatttggattattccatttgattaacttaggacatggggcacagctagatgcaactttccaacaagtttattatgcaactgctatcgggttagccttctcctatctgcatatttttactaatcgaatctggccatgtattctaatgcattttttattagatttacaaccaaatattgcaaatatgaatgctgaagcttcaccatggggtccgatattaattatttttggaattgtaataattgtttcgataatttgtatttatgtttttaataaaaggattaataaagttgaaaattaaaaaagcagatcaattgatctgcttttttattggaataattaaagtccaaatggaatcttgtaaaggaaaattccgatgattgcacctaaaataggagcaactacaggaacccatccatagctccagtgagcatcctttttattaggaattggtaagattgagtaaacaagtcttggaccgaagtcacgtgctgggttaagggctgggccagttggaccaccaagtgccataaccaaagcagtgattaagaatcctacaccgatattggcaatgtcaactgcttgtttgaagaacatacccttgtataaaccgattgcaacaaacattaagacaccagtaccgacaagctcagaaatgaaaccattccatttactgttaacacagtcactagtagcaaaacatgcaaaaacaatgttagagtcggtagattttttgatgtatggccagtaaatagtgataataagaagttgaccacaaattgcgccaagaacttgtgaaataatgtaaggtgttacttgtgcccaagggaagacaccagcagtagcttgagcaagtgtaacggctggattaaggtgattaccagaaattgatccaaaaagcattgctggaagcataacaccaaaaccaaaactgaaggcaattaaaatccaacccccattggctttgccatcatgagcattaccagtagttccttttaaaaatgagttggcaacggcaccgttaccaaacataaccatgattagcgtgccgaaaaattcggcaaaatacttgagcatccaactatgttccataagatacttttttcctctcttgaaaaaataagtgaaaaataaacacaagtactgattatacctaagtttacaaaaaaagcatagatattttttaaagaatcttgcaattttaagcaaaaagtttgcataataagaagataagtgtccaagctctaattacaaaatgtaataagggctctttttgttgttgagggaagtgctttaatgaataaaaaacagattacgatggtgactgtagcgttgatgttagggaacgttatggcaggtttagatggaactattactaatacggctattcctgccatcgtttcagcgctacatgggatccaatttatgggatggattgtggcaatctatctcttaggaatgtctgtttcaataccaatttggacaaaaattggagaaaaaattactaataaattagcttttgaaatcgcactagtgctatttgttttaggctcaacgtttgaaggactagcacctaatatctactttttcttaatcgctcgaatgattatgggaattggtggtggaggaatgggatccttgccttatattattgcaggatacgtctttccaaacattaagaaaagaactcaagttttaggatatttgacagctagtttcaatggagcagcaattttaggacctttagtgggaggttggctaattgatgccttatcatggcactgggtattttatattaatattccaattggtttagttgctttgttaatttccttgctctattacaagccagttacaccaaaaactgtcccagtttttgatttacaaggggcatttttgctagtgaatggtttaattatgtttttaatgggaatccaactcttgggattaactgcaacttggattgtagtagggttgatcctatttagcttagttttactgatctttttctttttgcatgaagctaaagcagaaaatccaattattcctttatctatttttagtaatcatgatctaaatggtgatttgattttatttgcgactacgtggggagcttttattgctgtaaatacatatttaccaatgtgggctcaagctcttttaggaatgtcggctttaatgggtgggatgacgttaattcctaactccatcgttgaaattattgcatcccaaacagttgctacaattcaagaaaaaattagaacttttacgctagtaatgattggaattgttacaatgatgatttcatctggtggtcttttcttagctaatgatcaaactcctctctggatattaattttgattggggcattttccggcattggagtaggatttatttttgttgcacttcaagtaaaagtacaaatcgatgctggaatggaagatatggcaactgcgacctcaacttcttatttaattagaattttagctcaaactgttatggcagccgtatacggggtcatcatgaatttagcgttagcgagtggcattaatacccattcaaatatcacgatgcatatgatgaatgaactaagtgacgcaaaatcagctaaattattgccacaatccttattgccagaaatgcggaaaatttttcacagtggtattcatgaaattatggcagtctcttttattttgttgataattgctactgtctttaatttttatttcaattttaggcagccaaataaaaaacttaatagatcatcaaaataaagcttgtgtttaaggaattaagcaagtatattttagataagattattatccttgattattgcaaaataattggggctttttatttcatagaaaagtaggtgtactgatgacaaaaaagcaagtaacgatggtcacatttgctatggttttggcaaatgtaatggcgggattagatagtacgattattaatacagcgattccagctattattgcagacttacatggaattcaattaatgggatggataattgctattatgctcttaggaatgtctgtttcaaccccaatttggactaaagttggggaaaagattggtaataagtcggcttttgaattatcgttactcttttttgtattagggtcactttttcagggactggcaaataatatgtattttttccttttagctcgagctttaatgggagtaggagctggaggaatgggctcgctaccctatataatggctggttttatctttgataatattaaagcgagaacaaaaattttaggttatttaggggctgcctttagtgtggcagctattatcggaccactagttggtggttatttggttgattcactttcttggcattgggtcttttatatcaatattccgattggacttttagcaatttttctttcattactctactatcgtgaaggtacaattaaagagactccaaaatttgatgtattgggctctttcctaattattgttggtttaactttacttttattaggaatccaactacttgggttaactagtagctggattgtgatcagtttagttattgctggtatagttttactggtcttattttttatgcatgaggaaaatcatcccaatccagttgtaccgattagcatgtttaaaaatcgtgctttagttggagattttttactttttatttttagctggggagcttttttagctgtaaatacctatttgccaatgtgggcgcaaggattacttggaaccactgcattacttggcgggatgacgctaattcctaattctttagttgatgttgtagggactttagtagttaaccccttaaaagcacgctttagtaatcgaactctgctctcaatgggattaatttgtattttgatttcgtctttaggtttagcactagcgccgcaaagtactaacatttggtggttagctggtatcggaactttttctggctttggtgtgggttttatttttgttttacttcaaataaaagttcaggttgatgctagtgaaaaaaatatggccccagcaacttcactctcgtatttaattcgtattcttgctcaaacgataatggcagctgtttatggtgtaattatgaatatggagttagcgcggggtgtaagagagaatcatggaataacaatgagcatgcttaataaattaagtgatgcatcttccgcaaaaagtttgccgcaacacttgctgccaacgatgagaaatatttttcatttaggacttcaagaaattatgtggtgtgcgactgctctcttggtggtagcacttttattaaactttgtttttaataaaagcgataagtaaggatttaagatcaaatataaaatagttacagaaaatttagctattcttaataatttgattttttattaaaaatatcttttaattagagaagtaaattataatttagaaaagagaaggattcttattttagacgaacaacccgcccgatggggctctaaaaattattataaagttaaagatttatattatagtgcttttccggaatgggaaaggttttcttggttctcaatggtattaatgagttttcgaagaaaactaaagctgaatgctgtctatgatggagaaacattttgtgggatgatttgttactacattagtgattctactgtgtacttagcctatttggctgtcactgcagaattgcgtggcaatggatatggaagcaaaattttacatatgcttgaggaaaaatacccagagcagcaaattgtattagatattgaaccacttgatcctgatgcagagaattatcatcaacgtgttagccgattgcggttttatcaaaagaatggttggcgtagaactcaccagatgttaatcgatgcagatggtgaatttgaagcattagtagatcaaaaccattttgataaaaaagattttgccaaaacattgaaacaaatgagtttaggtttttatcgttttagaattgaaaaataatatttttagtcactcaattattgagtgactatttttttatgaaaaagtataaaatagtataaaaatagatttaaagtataaaatagtataaaatagtatgaaaataataataggaggtgagatacatgaacccatttaatcctacatttggtgatgtgcctaaaatatttttggatagaaccaagcaattggatactgtgatcaaggggttagaacatgaaacaagtccgtatcatactactttggtttacggattacggggatcgggaaagacaacttttctaagtgacatcagcaatcaaatgtctaaaaaagataattggattgtaattaacttagctgttggagaagatttattaattacattagtaaaattaatctatgatcggatgaacaataaatttcataagatatttgatcagctagattggcattttgaactttggggtattagctttaataaggaatcacagaagctggaaagtaacgatacaagaataatcttagaaggaattcttaagcaactaaaggctaagggaataaaagttttagtaactttagatgaagctcagtctacagtagaagtaaaacaatttgcaacaacttatcaactaatgagacgggaaaagtatgatatttttttgattatgactggcttaccctcagaagtatctgaattacaaaatgatgatatactaacatttcttctaagaagtggaagaataactttaacgccgcttgatgctataagtatgaaatatagctatctctctgcttttacaaaaggtagaagaaaaattgatgatgtcgttttaactaaaatggttagaatgacggctggttatgcatatgcatttcaattattgggatatctggtttgggatacggaagataaattaattactgataacactctgcaaactatattgcctgaatataaggaaatgctttttagaaatgtatatgtaaaagtttacagctcattatcaccaaaggataaagaatttatacaagctatgattgagagtgatgaagataaagttgctattagtaaaataatggcgaaaatggataagcctaaaaattatatttctatttatcgccgtagattaattgatgaccaggtaatcattagtaaagaacggggaagtgttgaatttacgttgccatattttgctgattttgttgaagaatttggtgatatgtattaaaaagtaaaaaggcatgaaacgggggattgtttcatgtctttttactaaagaatattatctgtaatgtaagtaaggacaccttggtcattatttgatgtagttgtatgatttgcaatctgtaaaacggccggatctgcatttgccatagcaactccatctccaacttccttaatcatttctagatcatttccaccatcaccaaaagcagtcatttcagataaaggaatattaagtagcgtgccgagctcctgtaagccgtgagctttatggattccaggctgaatgatgtcgatatcaccatgaccgctgcttgtaacatcgcaataatcaaataggttttcttttaagaaatttacataataatcagttttatcatcgggacaagaaatagcaaatttaacaatgtggtccttaatatctgctagatcattaatttttttaagatgataatagtagtgagttgatacatcatagtagcagactgaatatctaattggaaaatacgcactttcgactccagaaactaaaaattctagttctggttgttttaataaaaagttgtagattactttacttgattcatctgaaaaataattcagttttaaaatttctttttgatttctaacaatcgcaccattttctgcaacatagattacatcaggaaaatctttaaagaaagaaacaagttggtaatattgattgccactagcaacagtgaatttaatattctttctttctaattcttgataaattttagtgaatttttctttatcataagttttattatcatttaagaaagtaccgtccatatcaacggcaattagttttgtcatttaattatctcctttaactacgtattactggggtataagatctcaaaatatgtattgataaattgaactcattttctataattagttatgtaattgatataaagaggggaaaactatgaataagagttcaaatggttgacgcgtctttttaaagagcgtctggtttggtattattgcgggaatgatctctggaatggttaagattggttgggagaaaatcttaccaccgagaaccttagcacgtgatgttgttaatccaccacaacatatgttacaacaaatgggtgcatcttataaatttactcatgcttacgtaatttataatactgatcaaaaagttttctgggttgccttaattttacactttagcttctcaattttctttgcatggcttttgatttatatggtccaattcaagaaagctgcttgggctggcctatgggaaggggctttgtatggaatcattatttgggtcgcatggcatttgattattatgcctgtccttggtacaacgccagcaccttggcaaatgccatttgcggaacacttctcagaattctttggccatattgtttggggttggtcaattgctgcagtaggctactacttaattgctaaacaaaaggttaagactttaacaaatcaatattggtaaaaacatcaatcaatctttcattaggaaggtcgattttttgttaaaaaacaaatttatctagtgctttagcaatcccatcattatcatttgacgaggtaatgtagtccgcatgatcttttgcttcttggcttccattacccatagcaactgcggtaccaacaatatcaaacattgaaatgtcgttcttttcatcgccaaaagcaatcatttcatctggagtaatgcctatcttttcacccaactcttttaagccatttcctttattaacattaggatgtaaacattctaggaaatgatcatcagctcgaacaatataaagattcttgctaaatttttctcttagagtaggttcaacttgatcgaggatttcctttgaaccaataaaacatccctttgaaatttcaaaattgtctggcatttcatcaggtgttcgaatgaacataggggctgtattttcccaggcctgaagcaattcaaaatagtctacatcatgatcagcagtaataattcttgaatcaggatcaacaatattgaaagggactttttgttctttggcaaatttaattaaagcacgataaagcgcattgttaactaaatcttgagtcattattttgccatcagcagttctggtgattgcgccatttaaagtaactgcatattggtcgctgccttcaatacctagttctttcatgaagtgagctaaacctgcaattggtcgacccgaacaaagtacaactttaattcctaggtctaaggctttttttatagctctcttggttgaaggtaagattttattttttgagcttaagagtgtaccgtctgtgtctaaggcaattagtttaatcaatttaattcctcctcgtgttttatatatgattaagatatcatttataaatagagactaagtgtcgttttcgtaactaagaagtaattattttgaaagggattacaatgattgaacatgaagaggttcaaaataatcagcgactaccattttatttttattatgataataaagttatgcagccggaacattggcatcagggaattgagctgaactatttaattaagggaaaagatcttcgttttgctcttgaaggacagacttatcatttcaatagtggagatatttggttagttaatcggcgtcaaattcatagtgcatcaggtgaagcaggcgaatgggaatatgaggggttaattattgatgatgattttttattaagccagtatccgtcaagtattaactggaatcttaacttattaggtcagaagagtacaaaaaagaatcgggcatataatgaattggtaaaagaggtagcagaacttggttggttatgccgaaaaccattaactgatgctcgtcgttttatagtattaagtcatctgatgaaaatcattgttttacttgatcaaaactttaataataaagagcaagttgttcaaagtcccaatctagctttaggggatgagataattaagtatattaacgaacactttcaagaggatattcaagttggtgatattgcagaaaagtttaatatttctcatgtgacattaaaccgtcaattgaagcagactaataacttaagcatgggaaaatatctaaaattggttcgtttaatgcatgctagagaactacttttgaatacaaataaatcaattgaattagtcgcttatgaaagtggcttttctaacactagagttttaaatagaaattttaagtcttggaaacataagactcctacagagtatcgtaatgaatttagcaaatattttagctaagagaacttgagtattatttgtcaactacacagcaattaaacaatatttttagtgaattaaaaaactagagctacattacttgcagctctagttttttgaaatattcaattaattaaaatatttttgttcagatttttctttcttttcagcttcaagtgctttttcactggctgcttgtttaggtaagatccagttcattaacataccaaagatggtacataaagcaactgaagttaattggaagttaccaagttgtaggtaggccccaccaataccaataactaagatgacagaagcgattaacatattacgtttttcgccaaagtcgattctatcatcaactaaaatctttagaccattagatgcaatggttccaaatagtaagaatgaaataccaccaataactggcattggaattgattcgatgactgcagcaactttaccaacaaaactaaagataattgcaaatactgcagctcctgctaatacccaaactgaatgaactttggtcatagctaaaacaccgatattttcaccgtaagaagtagtcggaggaccaccgataaaaccagcaataattgttgaaagaccgtcacccatcatagtacggtgtaaacctggattcttaaagaagtttctcttagttagagagttaagaaccataatgtgtcccatgtgttcagtcattgtaacaaaggcgattggggccattgttaagatggctgctggataccatttgaagtggtagctaattccaggtacatctaaagcgggcatcgagaaccaagcagcctttgctactcctgaaaaatcaactattcctagaacgcaagatagggcgtaaccacaaacgattccaagcataattgaaactaaactagtgaagcctttaaaacacatttggaaaattaaggtcatcactaaggtaaagatggcaacaccgaagtaagttaagttgtacttggtacctttcatcatggcatcatttgcagcagtagttgcaagagatagtccaattacgataatgattggtcctacaacaattggtggtaagactttgtttacccaattagatccaacctttgcgataactaaggcaacgataacatatactaacccagctgcaattgcaccttgagcaattgctggataaccgtcttgcttcattaaagcttgcatagttgcaacgaaagcaaaacttgatcctaagtatgctggaatcttgaaacgggttagtagcatatggactaaagtacccacaccagatgaaagaagagcaatacttggattaattccgactaagattggaaccagaaccgttgaaccaaacatggcaaacaagtgttgcatggaaagtagaattccttgtcctaattctggcttctcataaacgtctaagatcgcatcatcattatgaaatgtgtctttaggcatctttttcataatttcctccttgaaattaaaatcttgatgacctaaagaaaaaacgactatctaaagaagtttcctttaagatagtcgtttctgtttaaaactatgtcaaaaaatagtttacgcgcagatttccttgatagcctcacgggactatattaaaggtcatcacattatttctttcttaatttaactaagatataagaaaaaagtcaagcgtaaaatttgattgttctaactaaggtacgacgtcaaccatatgaagggtgttggtgaagagattcattctaaggatttgcctgcaactgattgggactggattatttattcacaagggatgtacgaccaattaaagcgtgtctatgatgattatccattagttcattcgatctatattactgaaaatggaatgggttataaggataagtttgaaagtgaagataagataattgatgatactccaagaattgattatctaagacaacatatggaagaagttgctaaggcaattgaagctgttattctagtaaatggttactttgtctggtcacctcaagacatgttctcttggacgaagggttattcaaagcgttatggtctattctatgtcgactttaagacgcaggagtgttacgcaaagaagagcgcatattggtataagaaattagctgaaatccgagaaatccctcctgttgattaagaaaataatcatctgtaaaaagctaagtactgaatgaaagtacttagcttttttgatggaaaagtttaaaagagtttaaaagtagatatgaagtttaaaagagtttaaaataaaatatgaagtttaaaagagtttaaaaatgaaaggagacattaaggtgaataatccttttaatccgacatttggtgatgtccctaaaatatttcttgatacagatactagaattaatgatttaatttctaaaattaaaactagtgattttgcccgttcattttttattactggcgttaaaggttcaggaaagactgtctttttaaacgcagtggctcaaaaattggatcaagatgataattgttatcggattaatcttattaataaagataacctagtcgcaagtttaacaaaaaagttagctatcaagactgaatctgcttttcaaaaagctttaaataatgttaattcaattactgtaaaaggaattaatatcgatttgaacagttctgaaacagaatatgatattgttttagaaaaaatactagaaaaagtaaaaagacaaaataaatacgtggttgttacaattgatgaaattactaataccgaagcagtaagagaatttgcacaagtcttcaatgaattaaagggagataatttaccgatcttcgttttaatgactggacttccagatttgattttagatattcaaactcagaataaattgacatttttgcttagatcagaaaaaattcacacattaccgttaaaaaatgcagatataattgcggcatatagttctgtgtttaattgctctttgagtgtagcaagtcgtatggcgaaaatgacaggtggttatgcatttgcctttcaattattgggatttttattgtttgatcaactaaacggaaaaatccccgaaagtgcagatcttgataaagtttcaattccatttcagttgcaactatttgacaatgcatatcagaaaatctttattgatctatctgaatgggatcgaaaatatttattagcagttaggggagataagcgacttcgagatgtagtaaagatcttagaaaaagataaagtttttgtggcacaatatcgaagaagagctattgagcgtaaattgataatcccagccggatatggactagtacaatatacgcttccatattttgatgagtatttgaaacaaactgaagatcccgattcagcttattattggggatattaggaacaatatttgggggataaattcataatgatgtcatgcgtccactaagtataaaaggattagaagatagaaaaaagctagttttatattttaagcaaaagaaaattgatgtagcatattctagtccttttaagagagcaattgagactattgatccaattgtgaaagataagcaaatttcatgtcttatagatgaaaatttacgtgagcgtaaaattggtaatgaatggattacaaattttaatgactactgtaaaaaacaatgggaaaattttgaatatcatctttccaatggagaatctcttaaggaagttcaagagcgaaatattaaagctttagaaaatatcctagagaaaaacttgaataagactattatagtgggaagtcatggaacagctataggaacaataatcaattattatgattctagttttacttatgaaaaatttgtaaaaattcagccattaatgccatttgttataaaagctaaatttaaaggcttggtattgaaggaatataatttagatttctttttaagataatgttttttataatctcaaatatttcacctaatcaaatgaatcgactatgcttaaagtgagagtgtattttcatagaaaagagatagctatgattcaattagaaaaattggttaagaaaaatttacctaaagaaaaagaaggaaaagttgctagctatattccagctttagctgaagttaatcctaagcaactcggaattgccttatacgatttagaagatggtgaagtaggtgaagcaggtcaaagtgaagtacgttttgcaattgaaagtatttctaaggtgattaccttaatgcttgctattaaaaagatgggcatacaagaagtatttaaacatgtaggctcccgtcaaacaggttttgccttcaattcaattctaaatatggaaattgaaagagctaagtatccgttgaatccttttattaacgctggagcaattgctacaacttcgatggtagtaagtaagactggtgacgatgcatttgaagaaattttagattttgctcgtgatatttgtaatgacccagatctttacttagatcaaataatttatcattctgaaagaagaacaggcaatctagatcggtcattagcatattatatggaatctaaaaacatgatgctcggagatgtagtaactagtcttgatacttactttaagcaatgttcaatgatggtgactgcacgttctttagcaaatttaggggctgttttggctaatggtggtgtaaaaccatgggacaacaaacgcattattcctgatgaagaagcaagatgtattaagtcattgatgatgaccaccggtctatataatcaatcaggaacctattcacgactaattggtgtaccaacaaagagtggtgttggcggtggtcttatgtctgctgcacctcataaatatggaattgggatctttagtccagccttagataaagatggtaacagtatcgcaggcttagatttgttgagagatattgttgatggattagagctggatatatttgattaggtaagaattgaaaaattaatattttagaagctaagcatgcggtaagtgcttagcttttttgttaaattataatggattgtgttgagctctttagataagtggtaaaataagaaaaaacattattgaaaacaggagtaaaaatgaaaagatattcaaaagcgatatattggggcttacccattagtttgattctcgccatttcgattattttacacttaggttggattaatgcctttgataatttctttgaaggattagttcacattgttcctaatttaaagggattgatgctaaaaattacatttttagcagataccaaagtcgatttgatctggatggtattaattgccgtaatcttgtggtttagaaaacaacgtcctcttgcgactaacttagttttaacaatgattacaggggatgcagttggttgggtaattaagcatttgattcaaagagctcgtcctgtacaacacttagccgttgatgatggatttagttttcctagtggtcataccttaggtatggggatgattgttatttggatcattatggtgcttttaccagtagtattgaaggatagaactaaacgtttttggattgattttctattgattgtttggttagttattgtaatgatctctagagtatatgtttatgctcactatccatctgatgtttgcggttcagttgcgattgctttaacttgggttggagtaatgcaatttgtctttaaaaagattaagcaagtaataaataaatagttaacaaaatagggttaagcattaggcttaaccctatttgtgtgagtagtttttatgattttatttttgattaagttaattgaacttatttagtcaaacaatgtccaaggttgacttggtctgtcatatagatagcctttttgccagttccattcaggatgttgcttcatgaagtctttggcgtcgaatggttcaccatcggctctgccaaaaatgccccacatattcaagttttcaatatcagtggcatcagcacacttaccatcacatgaaccacctgggaagaaaggtacattccaaacgccatgtggatcgtcagcatagtattgtggatcaacatcatagtgagcacaaatattacgtgaagaagcgcattgataacctaagtatggatcatacttatcagctaagattctcttagcaacgccatcatcaatagttccagatacttctggaagtaattgctcaaagcgagttctacgagcaccagtttgttgacgagtatcattatagccattgtcaacacattcaaggttacgaatccgtggattgtgacaagcattacagccatagtagaaaccatcagttgactctaacaattcttggtgttttaatccttgttcaaaacgtgcgatttcaccagtattaatgttgcaaaggagccaaatgttagcgtagccaccgttgttgccttcattaaccaattttacccattgatcaatattatttgcatattgggtagctttacgtgcacgaataaattcaggcattccatgtacatcatagccaacaaagccagcgattgttgtttcagtaataccaagaccagcatcagtaacgtagaagtcagtcattgaatcgatgtagccaggaacagtttgcatcttaaatgcatgaccgttagttggatgaacttcttcacaaacgttaaagtattgaccactccagaaatcatcgaaactttcatgagcaataactggtttgccatctcttgtggcagatcctgtagcaacaaatccagaacagtgagaaccgcgtggtccttgaggtggattgttagaatagttagctgcaacttgtggccaccaatagccagttacttccatccaatcattccagccgataacgtcatcaacactggtttcaaacccgttagctgtgaagccatcagccataccttgcatttcttccaaatattcttctggaatcttatctttgtgcattttaactgcttgattgacaaagaacgagtaatccattccatatagttcaagcgtcatatgagtgtaaacacgcactgcatccctaaattcatcagttaaaagataaccatgttgaaaaccaatttcataagggtcaccttgaactgttaaataatgccaaccattaacatcttttttagtagcttttgcaacaattttactttgtgtatctgttaatgtcataacattcaccttcattttttaatcaattaaagactaatcagataacattgcagtccaatatggaagattgatttcagctttttcgtaagcagcacgttccgtatcagtcaaatacttcttgttgactactgtgttataggtatattgatccatccatgaattatccatgatgaagtagcctttatgaccaggtttatcaccccatgaattttgaaccttccatttagttggttcattatcatgtaaatcaacaccacaaattaacatggcgtgagttggcatactttcacgatattgaactctagtagctttgtctttgcctaagctaataccaaatgaacgcttccaatcataaacctttaaagaaagtaaaccagcaggattattccattcttgtaagacatcacaagcaaaccaaacaggttgatcatcttttaattgatctatgaccatccgtctcatatcgtgcattggaacatttaagtaacgaatatttctaccaccgactacgttattgcatagttcaataccataggtttggttgtacttatagccgccaccaggtaagttcatgagttcaacatagtcatctaagttgatatctgcaaacttcttgtaaaattctaacggtgtaacttcaccagtagtatgatacttcttattcttatcacgatattcataagtgaatttttctggaggagtaccaaagcagatgctcaatacacgatagttttcttggtttagttgacgaataacgcttttaatctttgtatcagaagcattgctgttaactaaatcacgtaatttcattgcgtctttgtctaattttctgttatacatctgattaatctcagttgtattccaggctggggttgtttctggcatgagttcgtttggaactagaccatatttttcaattaagttagttaatagtggccaatcaccgccatcttcttgaggcgtagcgaggaggaacataacttcacggtcagataggggcttagcagcggtcttaacaatgttgttgtagaagtaattaccacgttctagcttgtcgtagaagaataggtaatctggagacagctccatatcttttaaattatgcttcttttcaattaagaaacgaacaaagttcaaaccactaaacatccagcaacgaccagaatgtttttgattcattactttatttgaatcaacatcaattgaaaagttaaaactactattttcaattgcacgttcattagtaatggcttttttaataccatttttcataactgcattttgagtaatacgtaatctttgagtatcaagaaagtctgatctgattgttttcaaatcagtagggttaatttcagacataatacaatctcttttctaatataaaactaattgtcggcatcagatgaggtaagcttattgtcttcagcagccttgacaactttagtggatacttgtgcatcaggactgtaaggacgtttaataggcatacccattggattttgatctttagacataatatcagttggaacgttagaagaaacttttcctggtttcttcaaaccttcgatttcccaagtaaatggagcgaatttgttggttggatcaacccaattgtggtgttttgaaagttgatacataacaaaacaaatacctaaaattactgctactaaaatcaaaataactgatatgtaaacaactggagaaccaacttcagctttaacttgtgctggtgggtagatggctaaaataatcccgaatatgctagaaagtaatcctagaccagcaacaaaccatgcaccaaatttaccaccgggaaccttaaaggcccttggacggttgggttggtcgtagcgtaatttcaaaaatgtcgtaaacattaaaatgtaatagaacaaatataaaacagtgatggtttgagtcaacataatgacaaaaccttcaacatttggaagtaacttgactaagtaagcaataattgtcattccggcaatttgggtatacatcaagtgagcaggcatttcatgtttgttcttttcttggaaccaatgtggcaaaaaaccagaacctccagcttgaccaagcataaatgaaggaccagccatattggtaataacactagctaaaacattacataaaccagcccaaactagaaccatatataaccatgggattccaatcgtagcacctaaggttctaaagactgtgttcaaagtataaataacattaatctgattttctggtacaaccatcgcaatgattacagtaccaacaacgaaaattaagaatactaagatcatagaaataaacatagccttagtaaagtctttttcaggatgttttaattgcttaatgtgagcggcattcatatcaataccagtatatgagaagaatactccggcggctaaagctaaagtagacattccgttccatttaggaattaagccttttggagtcattggaattgctggttggtggccttcgcataaccaaacaatggttaaaataatcattaaagccaagggaataaaggtaccaattaaaacaccatattttgctacattagcaaatgctttgacacctttggttgcaacaaatgttaagacccaatataggataataaatccagtcataattaaaacttcatgttgaggatgctgtgcaaattggacagctttatcatacatgggagtatagaacataattgttgcagcataactaggcattcccattccgaagttgatcatggtttgaaaccatagaattagtagacaagttagtgcccaacctttccccaggccttcgccgacccatcgaaagataccaccacgattactccaacctgatgctaattcagcggctactaaggctgtaggaatgaagaaacagatcgcaccaatggcaaagtaggttacagaagacaggccatagaaagcttgttgaacatcattaccgatccccgcgataatagtaacgttcattaatgttagtgcaaggatagaaatataaacctttttaaccgatttcttttccttgtcctttgcatcttccatcattatttatcatctcctaaataacatacgttaaagaaaaagctaggtgaattcacctagcttttctttaattttgtaaacgatcagtattaatggagaaacttaaacgagataaagttaattcatgttttactaaatttccgacagttttatgtgtaaggtcgagaaccttttgtgcattagctgcgttagctttagtcaaatattgaattagcttttgcccacttaatttttcagcttccaaatcagtttgatgaactaagtgatttgtaagttgatcggcagtaggtaaaaatccatctaatccaattaatagagatttcatttcattgtagcttggttgaattaaagcagcaatcgttcttgataaccaatatgcttcgtctgcatcatatgcgtcagtagtattctcatattgaggagctgtaccattagcattagcgtagaaaggaacataaggattaaatgcagttggagcaaaattaatccaagcaattccagcaattccagctggaacattatttctaatttcgagaatatgtgattcagcacaccttgccatagaaattggacggaatttagttctgtcatcttttggagtattgtcagctaatggatcatagattgtttcgttatagtgagaactaagaacatagccaacatcttcacgttttaatttccgatctggtttaaagctaaaatctaggtcgttgctggtaggtgagaaagcaatatgacctaaataacgttgaccaaaccaaacacgtggtgtgttatagcaacgatcacgtgaattagatgtaccaaaaatatggcggaagttaaattcatcaggatcagggttaagattattttcctctacaaattctctaatgccaggagcccacataaagcgactactgtcatcaaagtcgatatcttgtaaggaaacttggttggctattacagcagctttgtcatcatcaagtttttctgcaacccaatagtgacctgttggaatttccatataccaaatttcatctttgtcactaaaagcaattccatttccttcatgagaaccatatttttcaattaattttcctaggtattgaacaccatcgcgagcagaatgaataaatggcaatactatacttaatagagcatcttcaccaattccattacttactagtggatctaatcccaatacttgaggattcccatataagctttcagtagcactcatagcaacgttttcactgttgattccacattcaccgaattgaccgtgaattttataatcaacaaaaggagccatttggtaacgaagtgcattttcaggtagaggaatatctaatcctgttacatatgaatgaaaagtttgcttttctgatttagcaggaacaactacaaactttactggcacgttacatacttcagcgtcacaatctcgtgcaataattgtcgaaccagcaatattggcttttttaccaactagaacagtggtacatgccatatataatcgtcctttctaaagatatttttctctttaaattgggttcattgcgttccagtatggaagcattactggttctttttcataagcagcaagttgttcgtcagttaagtacttcttgttgacaacagtttcgtaggtgtattgttccatccagtcattgcccataatgaagtaacctttgtgaccaacttttggaccccaagagttttgaatcttccatctaattggcttgtcatcacgcatgtcaacaccagagataagcattgcatgtgttggtaaactttcacggtattcaaatctcttagtcttgtcagtacctaacttaataccaaatgaacgatcccagtcaaagactttttcagttaaaagaccagcttgtggtgcccattcttgaagaacgtcacaaccaaaccatacaggttcatcatctttcaattgttcaatagcagtcttttccatatccttcattgaaacgttgaagtaacgacttggttgtccaccaaccatattgccagaaatttcaactccgaatggggtgttgtatggatacttttcacctggtaagttcattaactcaacatagtcacctaagttaatgtcaacgaacttcttgaagaactctaatggagtaatttgaccagtggtgtggtattcattgttttcgtcacggtattcataagtgaatttctctggaggagtacctaaagcaatagctaatacacggtagttttctgcgttcatttgacgaagtacactcttcatcttttcatcagatgcatcactgttagctaaatcacgtaacttcaaagcgtccttttgtaactttctgtcatacatacggtttaattcttgagagttagcactaactgcatcttctggcatttcttcgattggaacaataccgtacttttcgattaagtcgactagtaattgccaatcaccaccatcttgttgtggagtagtaagtaaccagttaactagacggtcagacaatggacgatcagctgtgttaataatgttttggtagaagtaattacccttttctagcttgtcgtagaagtaaacgtagctaggtgacaattccatgtccttaatgtggtgctctttttcaatgtggtaacgaatgaagtttaaacctgagaagtcccagcaacgaccagattgtttttggtttaaaactttatttgaatcaacatcaattgagaatacaaatgggtgagaattaatttcactttgatttgtaattgatttcttgataccgttcttcattacggcattttgagtgttacgatactttggtgtatctaaaaattctgatctaacttgttttaaatcttcattatcaatttgtaccataataatctcttttctttaaaatcgataatctatttaactttcatcagttgaaatctcgttgttttcatcagctttaacaatgtcgtcggatacttgttcgtttggcttataaggacgcttgattggcatacccattgggttttgatctttagacataacagttgttgggacgtttgataaagcctttccaggtttcttaagtccttcaatttcccaagtaaatggggcaaacttgttatttggatttacccaatcagtgtgtttctttgaaagttgatataaaacaaaacaaactatcaaaacaacagcaactaaggctaaaataacagaaacataaactattggtgaaccaacttctgctttaacttgtgctggtggatagatagcaagaacaattccgaaaaccgatgaaattatacctactcctccaacaagccaagccccaaacttaccacctggtactttaaatgaacgagggcggttaggttggtcataacgtaaacgtaggaaagcagtaaacattaaaatgtagtaaaacatatataaaacagtgattgtttgagttaataagataacaaatccttcaacatttggaatcagttttactaagtaagcaacaactgtcattcctgcaatttgcgtatacattaagtgtgccggcatattgtgtttattgttcttttggaaccaatgtggcaagaaaccacttcctccgacttgacctaacataaatgatggacctgccatattagttacaaccatagcaattgtgttgaaaagtagagcccaaacaagaaccatgtacaaccaaggcatcccaattgttgatcctagaatcctgaatacagagtagagagtgtataaaacattaatttgtttttcaggaataatcatagcaatgattacagtaccaacaacaaagattaagaaagcaagaataattgaaataaacattgcttttgtgaaatccttttcaggatgttttagttgtttaatatgagctgcattagtatcaatacctgtgtatgagaagaatacaccagcagctagtgctaacgtactcataccattccacttaggaattaatcctttaggtgtcatcggaataacaggttgatgcccttgagctacccacacaatagctaaaataaccataaccgctaaaggaattagacttccgataataacaccgtatttagcgatgttggagaaagctttaacacccttagtagccaaataagtaaggacccagtataaaatgatccaacctgtcataatcaacaattcatgttgtggtgcttgggcaaacttaacagctgcatcatagttgggtgtatagaacatgattgttgctgtaaaacttggcatccccatcccaaagttcaaaattaattggaaccacaggataagtaaacaggttagtccccagcctttacctaaaccttcaccaacccagcggaaaattcctccgcggttactccaaccagaagctagttcagccgcaactaaagcagttgggatgaagaaacaaatagctccgattgcgaagtacgttactgatgcaagtccatagaatgattgctgaacatcgtttgcgattccggcaactatggaaacattcatcattgttagggcaaggacagatatataggtctttttctgttgagttttattgtcttccatgaaaatacccactccttctaaaaaggcaaaagaaactaactaaaaagatggttggcttgtgaatctcttttattagcaacatatgttattgataaaaaagagtgttagtaaaagatagtagttcacatgagttttcatcaaaatagaaagttaacaaaataaatagatatttatataacgacttgcaagttaaaataataattatctattcgcctattagattaggagttaaaaataaaaaaagcaaataaaaacaatcgtgataaatgggcttttttacgaaaaatgcattatattaactaatattaaataaaataactcaaacaaaagctgataaaataataaatcgaaaaaattcttaaaaaatatattcttttaagaataattattattttgtaggtaaatgaattattttttgaattcgatttcttttatttgcttttaaaaaggacaatcgttatggttgagatgagagttaatgttttagaaatataaatgaacagtttcaaaggtggtaagtactatggttaaaaaaactgttcctaaaaagttaacttttatgtcaatttactttttaggaattaacggaattataggatcaggagcatttttacttccgcaatctatttataaagatatggatctattgagtgtagttgtcttactttctgctgcattaacggtagggttaatcgcattatgttatgcggatttggctagtcgttttaccggttccggagctgcatggctatattcgtacaatgcatttggtagatttgcaggctatgagcttggtgtatttacatggtttttgggctgttgtacttatgctgctgaagtagtagcatttttaacaacgcttaaaagttttgtacctgcattcaatcaaagctcagtctattttgctgtcgggataggattagttttattgttctcaattattaatttctttggtcgtgccttagttaaaataattgataacacttcctccattgctaagctatcaactattattttgtttattattgttggtatgttcttcatgcatattgcaaacttccatcccgttttaccagccgcagctgcaaagggtgtaggaccatttttccatcactttggtgcagcctttagtgttgtgttttatttgtttagtggtttctcatttattccaattgctgcctctcagatgaaagatccagctaaaaatattccacgggctttagttgctgttatggttacggtaactattctttatactttgatggtattaattgctattggtattttgggtcacaagatgtcatggtacaccattcctattgctaatgcctttaagtctgctgtaggagaatggggctatgtgattattatcattggagttttgttaagtattttcggtgtggcatttacgtgctcgtttaatacaccagctttgattgcttccttagctctagaacaccaattattaccaaattgggtaggaaaaaagaataaatttgatgctccatgggtaggtattattttaactgccgctgtaaccttacttttaattactcaatcatacttgttcttagttggatgtattgttttagcttcatttgttcaatatgtaccatctatttttgcggttattaaatttaagcatactggtcaatatccaaaccatggctttaagcttccaggtggctacacaattccaattttagctttattagtagcttgctatttaatctttaactttacttgggaaactattttactctcaatagttgtagctgctgtaacagctgttttatacctgttcttaggaaagaagagattagctaagatgggcggaattccaactgcagttagagagaaaaagaatcatatagaagctgatttaaagaagaaaaattaattgattcaaattacgtttatttagaataaaaaatcaatttgtataaataaaaacagcatttctcggaggtattgagaaatgctgtttttatgctatttggaaagattttttacaacattaaaattaaacaagattaagtttaagacaacaatccctgctgtcacaatgaaaaccatactatagcttgaaattccggcaatgaaagatcctagaagaggccccgcaatatttccaatatacattgcactctgattccaagaaaaaattcgaccagtaacggcggcaggtgaatttttggttagtaaagtctgtacttgtgggaaaagacatgcgtcagtaaaaccaactaaaaagcgtaaaatacctagttgtactgtattgtgaacaaaggcagtcaaaaagaataaaattgttgcaccaataaaaccaccgataataattttgtgagtgccgattttatctcctaatgcgccaaaacgtgaagcagctaaaaatgttgcaattccaggtaaagcggcaataattccagaaacaaaaacaacatttccatgtccactcatcaattgtttaacatatagagaaacaattgggttaattgaattgttggctgcttggataattaaagtggttaacagtaaaccaaatatcagggttggagatcgtagagtagcaataacgccgctggctttatctaatttcttttctgtaatcggcttaaatccttcttcatggacaaagaaaagtgagagaagaaaggagattaataataatcctcctgtgataaagaaagtaacgcggtaactaaatgcagacgcaagtgctccacctaagaaaggcccaagtaagttcccggcagtaaaagaagaggccattgttcctagcgcttgaccagatttttctttaggtgtttctgtagcgattaaagcatttgaatttgaaacaaatcctgcaaaaactccctgcaacattcttaagaaaaatagttgccagacattagtaactaatcccatacttccaaggacaagggccatcccaagggaagccctgagaatcattagttttctaccttttttatcagctaatttaccccaccatggtgaaataatagctgagacgaagtacactccggaaaaaataaatcccgaccaaaagtttaactgttggtgagtaaaatgtcctaaagtatcgatatatagaggtaggaagggcataatctctgaaaatgcgattcctgcgataaatacggcgatagagagaacataaagattctttttccaaattggcttatctgattttatcgtaattctcatcctccaattttttaaaatctaccgttttatttttaagggatatttttcctactttgaaaccataatcgagtaattcttttttataagttaagaaagaataatcaattggtaggccgacaatcttttgaatttgattaaaagataattgaaagtcttggtcatgattatctttaatatattgccacaatggtaaaaatttgctcattagtttttctttctttaaatctgcttttccaaattgattgaaatcttttcaagtttagctaaagtatcaggatctactgttccaactagttgatttacttcttcaaaggcgtcgttcacttgtctaagaacctcaactccagctggaagtaagaatagttgtttttttagtccattgtttggatctgatcgacgttcaatcatttttcttttttctaatagcttaactacattagtaaaactggcaggttggtaaaaaagataatccgcaacttccttttgaatgcagccgggatgcttttgaatgtatcttaaaacatgggcatgcgtcattcttagattaatggaagctaggcgttgattgattaataggttttctaatttaccaatatgatatagcaaatttgctaagggtctttttcgcatagttttgcctttctaagttgtaattacaactaatactttaaataagtataacgcaactaattgtaattacaacttattttttaattcagagaattagtaattttagaaaaatcatacttacgatattttaacgctgcttttttgtctttaaacatagcactatgaatgtcaccggaagaataagctaaataaagacactcatttcctttaaaagtacctgtgatatagatgatatcaacagtatctaaaaatccacgtgctcggagccactgcgaaccatttttatcttcaaaagagaccatacttgcatccccagcataaactttattatttttttctgagcgatggtttaggtttaggtttggatctgttttttgataaacaactgaatccataatagtgtgcttagttataatgaattttctcgctgttttactgtagcgatcagtttgataccacgttccttgaaatacagtaggaatcgtagctaacttaaaaccagggtattctttatttaaattaggtttagaggaagttttagtggtagttgaagatgctgagttagaggatttagactgattatttttagaggtattactgcaagcagtaagtagtaagatggagaatagaattaaagctacttttttcatggttttttgtctctttcattgaatacattttctcataagtatagcagcaaaataccgattaaataaagagacctatttattcttattagctaaagctgagtagcctgcattatagtaaaaatccccatcgttcttcttcggaatcaaaccgattataaaaaccattaaaaatccctttaaaatggtatttatcatagtagtatttcatatatttcataaagagtgggcttgcggtataccaaaaatccattccggcagcatttgacattccgctgccggctccaatgataattgcatctgcttcattcacttgagctatgagttcattgattttatccattatgacctcctgttaaacatattgtttatttttgtacatactgtattgaattttcactagtagaataaaataaacaggtgatctaattaagcacaacttttcaatatgtgaataattatggacagtttttaaaatatgtagtgaacttaaaaatgcaagtatacatggacacattaagaatttaggcaaaacaaaaagcagacgttctgggggattagaagtctgctttttaatgtcgtatgttattttgggagaataagtaaggtgtagaagtccccttacttgttaaatagaatacctttctttttttaaagaagatttggtattagatttaaaatttgcaaagaatttctttaaaaagtttaaagacataaatataattaaaatagaagcgtttgcgagagggaaaattatgaaaaaagaacaagaaattcaaatgttaaaagaattttcagatgcaaattctacatctggatttgaagaagaatttgtaaaattattttctacttatgctaaaaatactgctgatattacggtagatgggatgctcaatgtatatgcagctaagaaggaaaataaaggtaatcggcctgttattcaaatggatgctcactctgatgcagttggttttattacccaggcagttcgtccgaatggattaattaaatttgttccacttgggggttgggtaaagtataatattccggctttaagagtgaaaattcgtaatcgtgatggtgaatatattcctggtgtagtggctacaaagcctccgcactttatgactgctgctgaaagaaattcaattccggaagttgcagatatgtcaattgatgtaggttcatcaagtagggaagagactattaaagattataaaattgacactggttgtccaatttttgttgatgtaaaatgcgaataccatgaaaaatccggtttattcttcggtaaagactttgatgatcgctttggtgcaggagccatggtagacgtcttagataatttgaagggtgaagagactaattttgatgtagtagctgctttatctagtcaagaagaggtaggacttcgcggtgcatatgtcactggacgaaaaattaagcctgatttatgtattgttttagaaagttgtccagctgatgatacttttgagcctgaatggttatcccaaactggcttaaaacgcggtccaatgctcagagatatggacactacatttttaccaaatcctaagtttcaacagtatgcttgcgatatagctgataaaaataatatttcatatactcgctctgttagaactggtggcggccaagatggggcagcaatttattatgaatatggagctccaacaattgttattggaattccggttcgttatgagcactccccatattgtttttcagcatataaagactttaaggcttcagttgatttagcaactgcaattattcgtgatatgacacaagaaaagctagatagttttaaggtgatctaatggactggaaagtatttttcaaaaaagtagcaatttttagttggtgtatggctattattagtgtattgatttatattgttcgttatacagcaagtgaaattggtaatctttttatgtggaatcaaccatttatttgggagctaattttcggacttgttttttgtctcttatcggttttttggccgaagaaaaataaatagaatataagttatagatatgaaccccgaaactaagataagaatttcggggttcatatcgtttataataaaaataaatatttatatagaaggttagctatgcatcttttagaaattaaaaatttaaattattctgttgatggaaatgctattctaaaaaatattaatctaagcgtaaattcaggagactttttaacgattgtagggccctcaggtgcaggaaaaagtacacttttaaaaattattgccagcttacttacacctacatctggttcaattgaatatgagggaaaagatattggtcaatattctccgcttgaatatcgtcggcaagtttcctattgcttccagcaaccatctctttttggaaaaacggtaagagataatctgatttttccttaccaaattcgaagggaagaagtcaatgaagagcatctaagtgaattattagataaagtaagtctaaatcagacttttttgaagaaaaatattaattctttatctggtggagaaaagcaacgagttgccttaattcgaaatttagtctttttaccacaaattttattattggatgaagtaactacaggacttgatgagaatagtaaagaaattgttcatcatttatttgatgatgtgcgcaagaagcatgttactatcttacaagtaactcatgataaaagtgaaattgaaaaagccaataaaatttttgaagtgaagaaggcattcctcaatgaaaaacgtagttgtcagtaactggtccctagtctttgcattcttattagttttagtatcaattggaatttccgttaaagaaaagctaggccttactaaagatattttgattagtgttgtgcgagccattattcagctagtcattattggatatattttaaaagtaattttcaatgtaaatactttttggctaacctttgtttctacacttgtcattatttttaatgcttcatggaatgcgaatggtagagatccaaatactaatcgaaaattatggaattcaattatagctgaggccgtaggaacctacattacattggctgtattacttctttctggcgtcattaaaccgatacccatgcaagtaattccaattacagggatgattgcaggtaatgaaatggttgcaataggtctttgctataaatctttaaacgaaagttttcatgatttaagacagcctgttttagaaaggttagctttaggtagtgatattaaaacggcatcgatgccaattattcggcgtagtattaagactgctatgcagccaacgatcgattcagctaaaacagtagggttagttaatttgccggggatgatgtcaggattgatctttgctggagtaaatccaatttatgcaattaagtatcagattatggtaacttttatgcttttatctgctacaagtttaggagcgattatttctgtttatcttgcctataaaaattattttaatgatcagatgcaattaatgctctaacaaaaagactgttctggtattatttcagaacagtcttttgaattatatgaaactaaaatttaatgtattttattccactctagcgatttcatcatgaactttaatattatgggaacctaaacttggctcttgaccatgaagattaaatttaacattaactcctggtctaaacaaaagaacatgagttgagccaccaaagtggaaaataccaagttgatcacctttattaatatgctgaccaactttaacagtgatttcgttgcccgaaacttctgccatacctacggctacaaagcacattaagccaatcttagggttgtctgctttaataaagatgacagcgcgtgatgcagtttcggtaatgtaagcttgagaatcattaggagcagctggatcagggccattaggattttcaaatccttgtggcaaagtttcagagtagtaagaaccgtataagttataagctttaactactgttccgctaactggactgttccatctgtgataactcaatgcactaaggaaggcctggtaaagtgtaccaccaacaaattctgatgttaatggatcattatggagtagatcaattaatgaatatggttgtcctttaatccagaatttagcctttaaaggtaggttatgggcgattcgatatggtgctgattcacaagcattagcaattgaatcagggtcatcggcattaacaactggacgaacacctggattaaatgttctagtaaagaagtgatcccaggaagtaaaaccatattgttgatcaatattatcattaggacaagcaaaaatatcatggaaatttttaccataagctgcgtcacacatgctctttaaagcttcatctccaagccaaccttcttgggaacgattgagcacataagtagaatcaggggattgtaaaaatttgccccaataatctaaaatatcacggagtttttgattaacgcgtggatccataaaagctacatagccagcttttgttgccattggataatctagaatagcattaatagggaaaccaactaatccagtagcattaaattctggagcacggtgcatcacccgattaataacgcgaagcatttgatgatagttgtgaacagcaggagtattcattggagttttaacatattttactggaacctcttcaaacatcatatggaataaattccaaagatagcggtcagattcaattaaatcttttagagcttgaacaggtggtaaaagagtttgatcttgttcagcttcggcttctttcaatactttttttaaccaagtattgtaaaattcttggtcactaggtaaccattgtccaacgttaaattttacatcttttttcatttttaacactctttttaatattaataactataatgaaatcttttttgtaataagaagataaatagagacaattgctaaaacacaaataataatagctaatgccaactcccatttgttaaataaaggagtaccgtctttgtcatattcttttcttgcaaagtagtagaagataatacctacagcgtaaataatagttgaaattaataagtagttaagcccagctgcatataggagccataaacaataaatggtggataaaattcctatgaataggctcttattacgcttgtgagaatcattagcaaaaatttctcgtttttgtgcaattttccaaagatacattgaacttaatagataacacggtaaaattattaccccagtaatatcaatacatgcaagatatacgttattggctgttaccactaagatcataaataaggacattaaaatacttgaaatatacaaagatacactaggtacttttttcttattttcatgagcaaagaattttggcaaaacatgtccctttgcggctgcgtatggaagttgtgccatcataacagtccaagcaacccatgatccaccaacagaaataattacagagatagttacaaagtctataaaccaaggaccaagtaaatttttcattaagtaagctgttgatgggtcagttaatttagaaagagttggttgatgataaataccataagcaacaatactgattagaacataagcgataagtgaggttaaatatcctagtactgtggctttaccaacatcttttggattttttgcatggttagaaataactaccgcaccttcaataccgataaagcaccataaagttacaagcattggagccttaatttgtgagataaagtttcctagatgcaatccttgtccccagaatccccagaaaaatgtaggaaaacggaagaagatcaacatacaaattaaaataatagccaagctgataaacttgataataacggtaatagtattaagaaaggttgcttctttaacaccattaagaactaaaaagttataaatccaaattaaaacaattccaaatacaactgttggccattggtgttttaataaaattggaaagtaacggccaaatgagtcattaagcataactgcataagcaacatttcccgtaattgcttcaatccaatagccccatgctgaattaaaaccaacatatttaccaaatccagctcgtgcataggaataaataccaatactcaaatctggtctttcttcggcaagaattttaaaagtaaaggcaagtccaaacataccaataccggttaaaacccacgctatgagaacagcaccaagagaggatgaagcggccatattttgaggaatatcaaaaatcccgccaccaatcatagcgccgactaccatagctattagaccaaagagaccaattttatgacttttagctttagtcattttgagatcttctttcttttaattaaaataatagcttatttaacacgtgctatttcttcgcgaactttaatgtttgaactacctaaaccaggttcttgatcatgtaaattaaattcaacctttgtttctggtctaaataaaagaacgtgagttgaaccgccaaagtggaacatccctagttgatcacctttattaacatgttgaccaactctaaccgtaatttcatcacttgaaacttcagacataccaacagctacaaaacacattaagccaatcttagggttatcggctttaatgaaaataacagcacgagtggcagtagcagttaaaaaggcctgagagtcatttgctgcaactgggtcagcaccacgttcatttgcaaaaccttggtatagactttcggagtaatatgatcctggtaaattataagcttttacgatagtaccactaactggactgttccatctgtggtaacttaaggcacttaagaaggcttgatataaagttccgccttcaaattttgatgtccagggatcgttgtgtaatagatccattagagaataaggttgtcctttaatccagaattttgctttcattggtaaatcatgcgcaattctaaatggagctgattcacaggcattagcaatagaatcaggatcatcaggatcttgaacaggacgaatgccaggattaaataaacgagtaaagaagttgtcccaagaggtaaaacctagatgcttttcacgatcttcagaagcgcatttgaaaatagtcgtaaatttgtcaccatctgctactttagccatttcatttaatgcatagtcacttaaccaaccatttttagatgtgttaagaacatatgttgagtcgggcgtttgtagaaatttaccccaataattcaaaatatctctaagcttttcattgatttttggattcatgaagaatacataacccgctttagtggccataggatagtctaaaattgcattaattggtgtaccgactaatccagttgtgttgaattccggagctctttgaataattcggttaagcattaataacatttgtttataatttcgaacttgtggggttcccattggagtatcaacatacttttcaggaatttcatcaaacatcatctgcgtaacattgtataaataccgatcagattcaattaaattctttaaagcttgaactggaggaagtaatttttgattttcttcactttccgcttcttttaaaaccttttttagccatttattgtagaattcttgatcactgggtaaccattgacctacattatattgaatattctttttcataatttctacctcaatatttatgaaaaacagttaataatatttaaaagtgcactttcatgttaaaaataacactaagaagagaaacagaccaaatatctagtacttttattccaatatcatatataagtaataataaaaaacagctgacttttacatcagctgtttttgcatacatttaatttgaaaatataactttaatctttagccgcatcacctactatactttcttttgatttactgttttcttcactaccattttcggctttaagagcttgtctatctaaagctttgaagaatggccaataacaaacaacagcaaaagctaaacaaattgcttgccaaacaactgctttccaatcaccaccggtaattaagaaaccgtttaggaaaataggagtagtccaaggaacactagcaataaccatatgaataacgccaaatttaattaagaagtatgaaattccttgtagaatcattggaactaagataaatgggatagataacattgggtttaaaacaactggcataccaaacataattggttcagaaatttggaagatacatggaacaaaacccaaatgtgctagttgcttataacgtttactttttgcaaacatcatacaaataactaagcctagaattgcaccagtaccacccatattcataccaaagtttaaaaatccatcggcagtaatatgagtagctgcagcaccgttcatagctttatgcatattgtccattaaaaaggcaccgtaaacaggaccagaaatagcaccaacagtgttgtttccgtgaataccaattgtccaagcaaataaagtaaagaatagtaaaatttccattccccagaagctgcctaaaccaacagtaagtggtgaaaagatccaagtaataaaggcattaatgtctaagtggaataaacatcttaaaacccatgctaagcctaggataacaattgcaggaattaaagaaacaaaggaactagcaactgctggtggaacagaatcgggaagtttaattacaattttatgtttgatgaagaaatcatagattgttccagataatagagcaattacaattgccgtaaacatactagtggaacccaaatttgctggatctagaaccattttgtcgtttaattcacaaataataaaagcaattgcgccaataactgaagcagataacttatcaattttattttcacgagctaatgtataagaaataccaattgccacgattaacccgatcatacccgtagtcatattaattggtgcatttaagattgggagatagggcttaataatattgttccaaccagtgatagggagattggcgataatcataaagattgagccaaaaattgtaaatggtacagaaataatcatcccgtctctaagaacaatcatatatttgttattaccaaattttcctagagctggcagaacttttgacctgacaagggtcataaacttactgttttgcatgagtgagacctccaaaataataatcactaatcatttaagtaagtaaagttaattaactaaccatctaaaatgtaagccctttctattaaaatgtcaagaaatattactaaaattataaaaaaccgcttatgtctaaggaattagacgtaagcgttttgtacctaaatggaagacttgtctcattaaaaaagaatagcttccaagtaagggtgcaaaggtagattgccgagatatttctagttgtgtacctgtattttgtaaaattggtaaattatttcgcaattggattaacaagagtggaaggttttcaattaaggttgaatcaagaaaaacaatttgaggggcataactagcaattaaattattaagcacaagcgagagtccttgtataaattgttttatcgacgctactactctcggattaccttgaacatataattttgatagttgctgtaacgaaagattgtttaatcctttctctttatatacttcttttagaattgcctcttgagaacaatattcaattggattaatttggactattttatcatcagttgatagtaaaaatttcatatctgcaatattgccagcagctgcttgattaccaaggtagaggttttcgtcaattataatacctgcatcaatggtttcgttaattgtgagtgaaatcaaattcttaatttcattatttgaagaaaaatctctttgaaaaattgctgctgcattagcgctatttaatagaatgacaggaacctcaaagtttttttctaaaactttaggtagatcaatatctttaagaattggcttttgagaaacattattgaaaactcgatgatgaacggcaagtgagatgcccagaagactatgaactgtactctttaaagcaaaattatttatctttttattaattatctgataaatctgctcatcacttttatcaatagttgatatttcttcaaatcgtgcgatttgtccgttggcccatgtagacataatatttatgtaatttttgccaatttcaatattaataaagtagccaaaatttttattaaattcaattaatttaggtttgcggccaccgtttttggtactttctccttcaccaatttctacaacatattgctgtgataagagatcctcaagaatacttgaaatagttactttgttaattgaaagatcacgagatattttacttctagatattggtccataattgatgacatgtctgatgacagagcgttcattatttaagcgcattgtatgtttattgatgaacatagtcctagctcctttataaatatatttattattatacaagttttattgtatgaaagtgtttacattatttaataattagtttatgctttacttgtaacgtaagtaaagataattaactaactcaaaaaggagaaagcatcatggcaatcttaacaatggatattggtcaaaagtttattcgctatggtttctttgatgacaaaggaaatcttactgagaaaggccaatatcaggttccaagacaatcagctgaagatttttataaatcaattgctgatttggtagatgaaagtgacatggaaattaaggcaattagtattagttttcctggttttatcaatgtaaaagataaagttgctattcgtgcaggttccttaagatttttagatggacataatattagtaaagatttacatcaatatattaataaagagattgaaatttttatcgaaaataatacaaattgtgctgcaattgctgaaaaattaaacggaaacgcacaagatgttgaggattttgtagtaattacattaggacatggcgtaggcggggcaatctttgttaacgataagttgctacgaggatctggttattctgctggggagtttggaatgatgattaccgactattcggcgcggcaatttatgacagctcacgagctagcctctacttcggctttaataaatgattatgcaacgatgcgaggaattcctagtgaattaatcgaagagtatcaaattatggctgaacttgataatcctaaagttcgagaagtaattgaaaaatgggcaacttatgttgcgatatgtatttttaatttagcttgtactttgaatccgcaacgatttttgattggtggagcactaagtcaaaataatgaattaattccgcttattaaaaacagactgatgcagataccaaattggtcagactttgatacagaaattcaatcctgtcgtttttataatgatgcaagtctatatggagcctactgggcatatataggaagtaagaaaaatgtatcataaacaattagacgaatttcctacagattttttgtggggagcaagttctgcagcttatcaaatcgaaggtggagctaaagaagatggcaaaggattatccatttgggataaatatgcacaccaagcgggtaatacctttaaaggaaccaacggggatgttgcagttgatcactatcatcgttataaagaagacgttgaattaatggctaagcagggattaaaagcatatcgtttttctgtttcttggagtagaattttgccagctggtgaaggtaaagttaaccaagcgggaataaacttttatcgtgatttaattaatgagttacgtaaaaataagatagaaccaattcttacaatctaccattgggatttaccgttagcactccaagaaaaatacggtggatgggaatctagaaagacaattgaagcatttgttaattatgcaaaaattctcttttcagaatttggagagaaagttaagtattggataactataaatgaacaaaatgtattcacgtcaatgggctatcgatggggaacacacccaccgaagaaacagaatatcaagacaatgtttcaagcaaatcactatattaatttagcgaatgcactagcaattactgaatttcataagatggttccagctggaaaaattggaccaagttttggttatggcccagtttaccccaaaactaatagtcccgaagatgtcttagccgccttaaatgctgatgattttaataataactggtggttagatgtttattgtcgtggaaagtatccattctttataagaaaacaactagaaaatttgaatttaatgcttgagatcactaaaaaagataaggctattttagagaatgatgcggcacatcctgactttttaggtataaattattatcatggaggaacggttcaagagaatcgattacaaaaaccggcaactaatgataaagaaaaacaatttaataaagtagacccatatttgatgcaacctaaaggggatcaagctaaaaatcctgaagttccaatgtttaatggtgtagaaaatgattatgttaataaaacaaattggggatgggaaattgatccaaccggtttgcggattgctctaagacaagtatatgaaaaatatcaactaccgatcatgatcaccgaaaatggactcggtgcaaaagatattgttgagaatggaaaaattaatgaccaataccgaattgattacttagcagatcatgttttggcaatgaaagaagcaattagtgacggagttgatttaattgggtattgtgcctggtcatttactgacttacttagttggttaaatggatattcaaagcgttatggctttgtctacattgaccaaaatgatgagcaaaaaggtactttaaagagaataccgaaaaagagttatacctggtacaagagtattatagcgactaatggaaatgatcttagcttgttgaagcatggagaacaaaaatgaagtatttgaatggaaattggctagttaaagatggtttttcaattgattatgcgcaaagcatatatgatagcaggattgaaaataatcaattaaccctttgggtcccatttaaagaaataacagacccaggaatgactttagacgatggaatgataactttagaagtttcatctccaagagaaaatattattaacaccaaaattattaattatcgtgggcatgtagatcatggtcctgacttcaaattgaactatgataaaaatatttcctcggaaataatagaaacagacgacaaatttgttattagatctggcaaaacaagattagaaatatctaaagggagtcaaattctttttaaatattattatgaaaatgaattgaaaactgaaatcgctcctcgctcaatagctagaatttttgatccggataaaaaggttcatatgtcgaattcttttgtgcttgaaccaggtgaaaaaatttatggtttaggcgagcgtttctctaattttattaaaaatggtcaagaaatagaaatgtggaatgcggatggtgggactgagactatgcagtcgtataagaatattcccctctatctttctaatcgacagtacggagtttttgttgactcaagtgaaaaggtctcttatgaaattgcctctcagcaagtagaccgagttgaattttctgttcctgaccaaattttgtcttactattttattggtggaaacaataataaagaggtattagatcactatactgctttaactggtcgcccacctttgcttccagcttggagctatggactatggttaacaacttcatttacaactaagtatgatgaaaaaacagttatgagttttattgatgggatgattgaaagaaaaataccactatctgtttttcattttgattgttgctggatgaaaccaacagaatggtgcaactttgaatgggatcctgatgttttcccagatccagcggacttacttaaaaagattcatgcacgtggtattaaagtgtgtgtttggattaatccatatatcgctcaaaaatcccatttatttaaagaagggatggaaaatggctactttattaagcggacaaatggagatatttggcaatgggacaagtggcaagcaggaatgacgattgtcgactttacaaatccaaaagcagttaaatggtatcaaggatacttaaagaaactacttagacaaggtgtggatgtcttcaaaactgattttggagaacgaattccaagtagtgatgtgaagttttttgatggctctgatcctaagaaaatgcacaattattacacgcttctgtataacaaagtcgtaactgaagcgattgccgaaataaagggtaaaaaagaggcactagtttttgcaagatcagctactgttggaagccaatgttatccagttcactggggtggagactcgtcctccaattatccttcgatggctgaaacgttacggagtggcttatcgtttggaatgagtgggtttggatattggtctcatgatatttcaggctttgaagctagcgctacaccagatctgtatcgtcgctggacacaatttggattattaagttcacattcacgctatcatggatcaaccacttataaagttccttggctatacggagaaagatcagttgaaaatacaaggaaatttacgcacctaaaattgcagctattgccatatctaatggctatgtctaatgaagctcattatcatggtgttccaattttaagatcgatggttttagaatttcctgaggatccgggctgtgaggacttagatatgcagtatatgttaggtgataatttattagttgctccgatttttaatgagcaaggaatcactactttctatgttcctgagtctgatggtaaatggattaatattttaaataataagagttatgagggtggaaaatggtatagggaaaaatttgatgattttactttgccacttttagctcgcccaaactcaattattgttactggtaagcataatgataagacgatgtacgattttacagatgagccaattgttaatatttatgaattaaaagatggaaaaatttctaccatacttactgatagttacggtgaaaaaattggaactattagtgtagaaaagaaaaacggcaagattattgccgatagcgatgtcgtaaaagaatttactttgagaatttatgatgcagataaaaaagcaaaagaactaaatacaaaaaatggacgaattgaagtttaaaaaagcgatatgatcattttaaaggagagctacgttttctgaattacagaatagaaagaaacaaggaataaaatcatgaagcgtgccttagatattaaccaatttttacatggcggtgattataatcccgaacaatggtgggatgagcccgatgtaattaatcaagattttgctctctttaagcaggctaaaattaataccgtgactgttgggattttttcgtgggccaaattagaaccgcaagaaggaaattatgatttttcttggttagatgagatttttgatcgagtagaggaaatgaatggtcatgtaattttagctacgccaagtggagcacgaccagcctggcttgctcaaaagtatccagaagttcttagaacagataaccggggaaataaacgtggctttggtggacgacataatcattgtttaacttcacctatttatcgaaaaaaagtttatgagattaacacaaaactggcagaacattttggtcaaaggaaaagtttggtgctttggcatatttctaatgaatattcaggtgaatgctactgcgatttatgtaaagatgcttttagaaaatggctgaaaaataagtatggcgatctagctactttaaatcatgcctggtggaacactttttggagtcatacttataatgactggagtcaagttaatccgcctagtcctttaagtgaaatgggtaataaagggatgaacttagactggaagagatttattactgaccagacaatttcatttattgataatgaaacagcacccttaaaaaagatcactcctaatattcctgtaactacgaatatgatggctggaaatccgttgatggatccatttgctggttttgattatcaaaaggtagcgcgtcattcggattttatctcttgggattcttatcctgcttggagtaatgacagtcaaagtactgaagaacttggacgaaatattggattaattcatgatttctttagaagtttgaagcatcagaactttttagtaatggaaaataccccatcacgtgttaattggcataactttgatcgtgcaaaaagacctggaatgcatgaattggctagtctgcaagatgttgcgcatggtagccaaggagtattgtatttccaacttagagcttcgcgaggatcatcagaaatgtttcatggggctgtaattgagcatcgtcatcctgaaaaaacgcgtgcatttaaagacgtaactaaggttggtaaagacttggaaaaaattagcccaattgtagcaacaaattatgcaaaagcaaaagtcgcaattgtctttagctacgatagttactgggcactgcaagatgcggaaagttatagtgagaataaaaaggtctggcaaacaattcaaaagcattatcgatatttttatgaccatgatattccagttgattttgttagtcctgaagatgagttttcacaatatgacttattgattgatccaatgcactttttaatgagtaagtcctatttagaaaaaatagataattatgttaagaatggtggtaagatagtcggcacttatattagcggagttgttgatgaaaatgatcttgcctatatgaatgaatggccaaaagaactacaagaaatttacggacttgagcctcttgaaactgatgttttatatcctaggcaatcgaatttaattaattttgaaggaaaagaatatcctgtgcacgattattgtgaaacgttaattaactgcacgggaaaagttttggctacatacagtacagatttttatcaagatacacctgctattgttgagcattcctacggagctggcaaaagctattaccttgcttgtcgtactgattattctttcttagaaaagttttatgaaaaaatagctagtgaattagttcctgaaattccaattacaaaatttaatgatagagtttcaattcaaatacgtgaaaataagtcagaaaaatattggtttgttcagaatttttctgataaagaagaaaaaattgaattgagttgtgaattagttaatttgctagataatacaaaggaaacaggcgaagttgttttagaaccatttgaaagtaaagtttataaaaataattagttctaatttgtttgaaacgttttaaaatattaaatcaaatattggaatgacaagaatatcctaaaaagtataaaaattaatttataaataattttattttctaaaatactgatatatcaacatttctgaatgctgattgtcagtattttttatttccttttatagaaagcgcttgcaaattttgaaaatcatagtatatttaaattgtaacttaaaacgtttcaagttttaaaaagccgttagttaaaagggctttagtgtacatgtattagtttatttaaaacgtttagatttgtagggggatttaaaatgccaattactttagcaagaattgatcaaagacttattcatgggattactgttaaccaatggaataaagtattgcaccctaagagattcatggttattgatgatgaagtcagtcaaaatgaaatggtaaaagccagcatgagaatgagtaaaccaaccggtactgggatgtcaattataaatgaagaaaaagctataactaactttaaaaacggaaaatatgattcgcattcagtttttctaatagttaaagagcctcattatattttggacttaattaatgctggagttgatattccaaaagtaaacgttggagctttattcgaagaaggagatagaaagccatatactaagcgagttgctctagatgaaaaagaattatctgatttaaaggcaatttctgataagggtattccagtattttttgaatatacaccagacgatgaaaatgaagtttcacttgaagatgtccgaaagagtaaaggggagaattaattatgcctattgtcttacaaaatattctaatcatcttattagctgcctatatggcttgggataatggtactggaaatcaaattacaggtaattggccagttatcattggtatgctggtcggtttgattatgggtaatttaaatgttggtttagttattggtggtaccttacaactgatgtctttaggggtagctgcgattggtggatcctcaattccagaatatggagttgccacaattgtaggtgtttttatagcaattagaacaggagcttcaacaggtactgcaattgctgttggattacctgtagggatgttaactttacaactcgatgttgttattaagattattaataacttctttgcacattggtcacaaagactacttcatgaaaagaagtttaataaaatggatggagtattttatctaactatttttgtttggatgcttaagtacattattccaattggattagttgtaatgtttggtacaccaatcgttaagttgattcttcatgttattccaacatgggttacaaacggattgactattgctggaggaatgttaccggttgttggtattggaatgttattgagatttatgcctgtcaaaaaatatttggcttacttattagctgggtttgtattagcaggatatttaaaggttccaattttaggaattgcaattttaggtttagctgcaacttatgaaatttatcgtattaattctgctaagaaggatacgcaagaagtccaatcagcaggtgcagtagaagatgaaggagacgacttcgatgagtaaagaaatgaatcaacctgaaaatggtaaaaaattaactgtccgtgaacgaaaaaatatgtttagacgttggattttcaatgctggtttaggctacaatttcgaaactcagcaggctccagctgtagcattttctatgagaaaagctttaagaaaaatttatccaaatgacgatgaatatattgaagctatggataaccactataaatacttcaatgctaaccctttgatggctaatattattctcggtgctactcttgcaatggaggaaaaagacgggattaaagctaaagatgcagttcaatcattgaaaacatctttgatgggaccattttctggagtaggtgactcagtattttggattttaattccaacaattatgggatcaatttctggttatatggctctacaaggaaatgcagttggtgcaattttatggatgctattacaactttcattttactggctaaagatgtggttctttaagacaggatatgattcaggtacaaaattaataacttcattaggagaaaaaataaatatttttactgatgcaatttcagtaatgggattaatggttgttggttcattaattcctacagttgttaaagtatacactccattaaaatttagaactggaaaagttatgctttccattcaaagcggagttttagataagattatgccagcattgcttcctgttgctgttactggtctagtttattggctattgggaaagaaaaagtggactccaactaagattatcttattaattattgttatttgtttggttggtgcagctttcggtgtattaggcgttgcaaagtagaataggttggaagaaaaatggataatattaaacgtcatattgttattgcgtcacattcaacattagctcaaggaatggcaaatgctttgaaatttttcgagggagataatttaaaattaactgttttatcagcatatgttgacaataagcccatcgaaggacaaattgaagagatttttgatcaatttgataaagaagatgaggttattgtattaactgatttgttgggtggttcagttaatcaaaaatttttcccgtatattaaccgaccgcatactcatttgataactggaatgaatttatcattagcgatggcgattacaatggaaccagttgatggctatttaatgcctgaaaagatccaatctattgtctcagacgctcaaagccaagttaaatatgtaaatgaattagcaaatagtgcagatgaggacgacgaagatgaatgattggaaaaagaaagctgtagtgtatgaggcatatgtacaaagttttaaagattcaaatggagatggaattggagatattcagggactaatagaaaagctagactatataaaaaatttaggtgccaatgttatctggttaactccaatttttaaatctcctttagtagacaatggttatgatattgcagattatcaggccattaatccaatttatgggacaatggatgattttaagaaattattgagtaaggctcatgaaaaagggttgagaattgtcctggatttggttgttaatcatacttctgaccaacataaatggtttaaagaatcccaaaaaaacaaagaaaataagtattctgattattatatttggcgtgatccaaaagaagatggaagtgcacctactaatttaggctcagcttttggtggttcagcttggacctatgttccagaaagaaatcaatattatttacacctttttgcaaaacaacagccagatttgaactgggataatccagaagtaagaaatgatatttataaaataatgatgttttggttagacatgggagttgatggctttagaatggattccattagctttatatccaaaccaagtaaatttgaagatgcgcctttagaagataataaagagtatggcgcttattactatggatcagctaacggtccacatattcatcaatatttacaagagatgaacagagaagtactaagtaaatatgatgtaattgctattggagaaacgccacatacaagtgctaaagaagcaagattatttgttgaacctgaacgacatgaattagatatggtatttcaatttgaacatatgcatgttgattatggaaaatatggaagatactctgatgtaacttttaagatgagtgatctgcgcaattctatgtcgagttggcaaaatagtctttcttggaattcaaattatcttggaaatcatgatcaacccagaattgtctctagatttggaaatgataataagtatcgaaaagaatcagcaaaaatgttggctatagtatctttattacaaaagggtactccatttatttttcaaggtgaagaaattggaatgaccaatttacatattaagaaaatagatgagttaaaggaccttgaagcacataatatatataattttttaagatcaaaaggtattagtgaagatgacgcattgaatatggtcaacaggaaaactagagataatgcccgtacaccaatgcaatgggatgaatcggaacaaggtggtttttcaagtgaaacgccatggatggaagttaatccaaattataaagaaattaatgtgaagaaagatttgaaagatccagactcgatatatcatttttatcaaaagattttgaaattaagaaataataatcaagtattgttagatggaaagtatgagctagtttcttctgatgattctgcagtttttgcctatactcgaagtacggggaaagaaaaattggcagttatttgttcttttgtcccatataaggttaaatataatttgcctactgattttgtaaatagaaatgaattgcttttatctagctatggtgacaataaagcaaaagcctcaaatgttatgtatttaaggccttatgaaggagttgtgattagacgtgagtagcatgaaggatgtggcgcgtgaagctaacgtttctgtggcaacagtttcaaatttcttaaacggaaaaaaagtacgtccaaaagctgcaaaagaaattgattctgcaataaaaaaactaaattatgtaagaaataatgctgcacgttttttgaaaacgcaacaatcagcttttgtagtttttgttgttccaagtgtatggtctccattcttttctgaattaactttttgggttcaaaaatacttagatgaacttggatataaaatggttctatgtgtatcagagaatgattatcaaaaagaaaaaagttacgtcacgatggctgaagagcagcgtgtagctggaattctttcaatctcttattccgatttaactagtcatgtacattctgacatcccccttgtttctattgaaaaagaaagcacaggtcaattttcactagtatcttcagataattatgaaggtgggaagatagctgctcgagaactaagcaaaagaaaactgagtaatttgatatttattggttcagctaaccataattctgttgaaatgaatgcaagaaaagcgggatttatagattattgtaataatcatggaattaaattcgaattaactgaaattgattcccggaaagatgataaacatgtaatcgaacatttaatccaaaagataaaaaacgagagcacaaattatggcatttttgctcatactgatgaattggctcttgtattaactgaagaatttcaaaaagcagaaattgcagtccctgaacatgttcagataattggttttgatggttggcaacttactgctgatacaccactgaccatttcttcaattagacaaaatattgaagcaattgctaaaaatgctgttgaacagttacataaagagatgcaaaatccagatcagaaggagatttcacgtttaatgattcctgttacttttcgagcaggagagacaaccctaaattaataaaaataattctctaaatatcaaacagtcatttgttagaattatgagtagaattcatgattcttttctacgtaaagtcaagtaccatgcagtatttgacttttattttttatgcttattttctttgcattgctctataccaatttgactatctattataaataggtataaaataaacctttctgtgtatataaaacacataatacagaaaggatagtttttaatgaataattcaacaacagagaagactttctttggacaacctcgtggcttgtccaccttgttcttcactgaaatgtgggagagatttagttactatggtatgcgtgctattttgctcttctacatgtattatgctgtagaacgtggcggactaggaatgaatgaagccacggctgcttcaatcatgtctatctacggttcacttgtttatctttctacggtagctggtggatggctagcagacagaatttggggagcacgtagtactgtcttctttggtggtgtccttattatgattggacacattatcttagccctaccaatggcagaggtaggtttatatatttcgatcgcattcattgtggtaggtacaggtttacttaagcctaatgtttctgatatggttggtggcctatactcattagatgatcgaagacgtgatgctggtttcagtatctttgtttttggtattaacttaggatcagcgcttgctccatggttagtgccttgggcaagtgaaggttttggccttaatttatttggaaatcattttaatttccatgctggtttctctttagcagcagttggaatgttctttgggttagtacagtatgtttggggcggtagaaagtatctctctgaggatgggatgcatccaacagatccaatcgatcccgaaactcgtaataagatcttaaagagaatcggtttaggaattttagctttagcagtagtattaggtttaatggctgcttttggtcaattaaatattgataatattattactttaattactattgttgctattgccttaccaatttattactttgttttaatgcttagaagccctaaagttacaaaagaggaacgctcaaaagtttgggcttacattccattatttattgcagcttctattttctggggaattgaagaatctggttctgtagttttagctctatttgctgcccaaagaacagtacttcacatcggaggatggcactttaccgctgctaacttccaaactttgaacccagtatttatcatgattttgactccgttctttgtatggttatgggataactggaagaaacaaccaagtgctgctggtaaatttgctgctggtttggtctttgctggtctttcatatatgtggatggcccttccaggaatgctttatggaacaaacggacgagttagtccattttggttagttggctcttggtttattgttgaaattgccgaaatgcttatttctccaattggcttatctgtaactacacgtttagcaccaaaagctttccgttcacagatgatgagtctttggttcttagcagatgccactggtcaagctatcaactcccaaattgttaaatactactcaagtaaaactgaagtggcatactttttagcagttggaattgttagtgtattgtttggtgtagtgatgtttttctttactaagaaaattcataacttaatggcagatgctgagtaaaacaaacataatttaatatttaataaggaaagatttgatgggtaattcgaatttttccttatttttttataaaagcattagctcacacttttgaaaatgcgttttagtaaaatttttgcgcctaaggtaatacaatgaaaaatgaataagaaaggttatttaaatgaaagtgtgatatataatgattgaaagtaatcacagtgcatgtacatcaattctaattgggaaaaatgctactacagatggcagcattatcattggacgtaatgaagatgataagccaaactgtgctaagcatttagcttttcatgaagaaaaggatattcctaataatcactttaagtctaacttgaataagtttgaaatggatttaccaactcatagatatgcttattcttcaactccaaactggagtgacaagaagggtgtttatgaggaatccggaattaaccaatttggtgtagcaatgagtgctactgaaactacttatgctaatgaccaagttcaatcttttgatccatttaagaagaccggtatcattgaagaagcaatggtaacttgtattttgccttatgtaaagacagcacgtgaagctattgctcgctttgctaagattattaaagatcatactgcaggtgaatcagatggtattttatttgccgatcctaaagaagcttggtacttcgaaattggtactgctcactactgggtagcacaacgtattccagatgattgctatgctgtagctgctaatgaattagcaattcaagaaattgattttaatgactctgataacttcattactgctcctggtttacaaaaatttgttgaagagcataatttatggccaaataataagccatttaattggcgtcgtatttttggtacacataatctgttagatttaacttataacactgctcgtgtttggactggtcaaagaatcttaagtccttctattaagcaagaaccaagcagctttgatattccatttattcaaaaggcagaccatccaatttcaataactgatgctcaaagagttttaagagatcactacgatggaactaaatatgatgtagcaaatcctgttaataaagatacagccgtatatcgtccaattagtgttgactttactgaggagtcacacttactacaacttaaaggtaaggattggattcactggttatcattaggcattacttgtcaaaatgtatatgttccattctatccacaaggtagcgtagtgccaagcttctatagacacggcaaagataagtatgcttcaaactcagcatattggatctacaaggaagcacaagtcttagctgatcgttcatggaaagactatggtttgcaattgtatcaagctagaaatgctacacagcaaaaattaagtcaaatgcgtattgaatatgatgccaaagttgataaagaaaaggatcctgcaaagaagttagacttaatcaacaaggcaaacaaagacttagctcatacagcagttaaggattatcaagaattaattggtaagttgattacaaagcaaataaagaaatcaccattgcactttagaagagacccagacttataatctaggattgtaaatcataaaaaaacgagtagaataagttctgaagaaataattgaatgacagagagcattcgttttggaggaatttaatatggatacactggttaagcacagacatactctaagcaaaaatcagaagtgggttattgcatctacttcgtcaggttttgcgcttgagaatatggatgtgctttttttatcgtttgcaatgagttcgatgattgctgatctccacttgtcaggtggagaggctggttttatttcaacgattactaatttaggaatgttagttggtggaattgcctttggaattttaggtgataagattggtcgagttaaaacctttagccatacagtaattatttttgcaattgcaacagctttgatggcatttaccaataatatttatcttatctatgcacttcgttttttagcaggaattggagcaggtggagaatatggtgtcggaattgctttaattgctgaaaactttcataaagaacaaattggtaaaatgacctcagtagcagcgattggtggtcaaattggagcaattttagcggctttaattgcagcttggattattccagcagcaggttggcatatgctatttttaatagggattcttccagtaattttaactatcttcattagaaaacatgtccatgaaagtgagcaatttattaaggctcaggctagtgaaagtaattccttattatcggatgtggctaaaaaaatgttttcaacaccacatcttgcttggcaaacagtgggtttaatgattatgatgacagttcaaattgctggatactttggtttaatgaactggcttcccacaattgtacaaaagcaattgaatttaaatgtttcgaattctagtctttggatgatttctacgattattggaatgagcattggtatgatgacatttggttcaatttttgactactttggtcctagaagagccttcgcaattttcttgattggttcagctttaatggtttataccttaagtttggcccaaaatatggccatgcttttgattattggagctgtagttggctttttctcaaatgggatgtttggtggctatggcgctgtaatcagtagattatatccaacagaaattcggtcgagtgccaataatattattgttaatgtcggcagagcaatcggtggattttcatcagtagtaataggtattttaatggataaatataacttaggcgtagtaatgggctttttatcagctttatacctacttagctttgttgtgatgattactttaccaggcttaaaaacgttaacaaaagaagctaaaaggaactaaatatagcttttaacgataggaaactagtaagaataaatatttttcaatcgataattgtccttatatactatagaaaagtaagtgtgagaggaaataattatgaagaagaaaaagatttatcttgctagtttttttgttgcattatttttatttgtgttagcgggatgtggtcaaaaagctcaaaatgttcctgctaaaagggttactgtatctttaaccaatactaaaacaattcccacatttttctttcatggttggggatcaagtgcgaatgcggagacccaaatggcgaatgccgcaaaaaaggctggtgtaagtaatacaattattcaagcagatgtaagtaaaaatggcactgttaaacttaaaggcacgatcccaaaaaatgcaaaaaatccaattatcaaagttaatctagaagataatcagagtggaaaaacatcatatgtaaaagatgtaataactgcaatctctaataaatatcattatgcaaagattaatttagttggtcattcaatgggaaatctacaaattgctaactacattaatgaaaactatgacaataaaaaattgcctaagattaataaagtagtttcaattgcagggcattacgatggctatcttgatgaagaagctggccaaaaggctaagatccaaaataagaaaacaggtgaaccggatatttatagtgatggctttaagcaattattacctttacggaaacactatccgagacaaattgaggtcttaaatatctatggtaataaagaggatggttcaaattctgacggatcagtttctgtagcatcggcacaaagttataaatatttaattaatggccgtgccaaatcataccgtgaagtagaaattaagggtaagaatgtacaacatagcaaattacacgaaaataaagaagttgataaacttttaattgattttttatggaaagaataataaaaagttattgacaatagtctctgtgaggtgaagtatggaattaactgctaccgaaaagttgaattttgcaattatccgaggtggaaaagcttatgcagagtgggatagacaacatggcatgccaagttatctaaccattattttgtatgaactattaatgcgccaaagattaacgcaaaaagatctggtcaacttaagtgacttaccaaagcaatctattaataaaggaattcaccgcttactagaacaagattatctagaactgacaattgatccagaagataatcgggttaagtattgccagctaactgcttcagggaaaaaatacgctaaaaggaaaatggctcctttatttgaaattgaaaagcaaattgcacaaaaaatgggcgcacaaaagatggaatagttagtagctctaaatgaagagtggagtgataccttttgggagcttttaagaaagaagggagaataatagatgcaaattttgaagccatacttcaaaaattatcgtaaggaaataattttagcgattattacaattctgatttctgcttttgcaaccttatggcagccaagattattagaaaatatccaaaaagcaattttagcggataaccagagtgttgtcttaagagatggaattggattagttgtactcggtttattagcaattattgctggtatttttaacgtatattatgctgcaaaaattgcccagggaataacctcagatttacgtgaagaaacttatgctaagattcaaagtttttcttttggaaatattgaaaaattctctagtggttcattagttgttcgtttaattaatgatatgaaccaagttatgaatatgatgatgatcttattcatgcaattactcagaatgccaattattttaattggatcatttgtattgagtattattaccattcctcaatattggtgggctcctgtattaatgctagctttaatgatgggggttggatacattgttattcaaaatatgaataaactttttgctaaattccaacactacatggataaaatttctactcgcgttaaagaaaatttacagggtgtacgtgtagtaaaatcttttaatcagggagaaaatgagattaagagatttaacgaaacttctgatgatttaaacgaattaaatattaagattggttactggatttctactattatgccagctttcatgttaattgcttatttagtaattgctttggttgtctttttagtaggacgcagtgctaatttaactccaactgatgttgcagttgtatcaccatatgtttcttatattttaactttgctctttgcaattttaattggtggttttgtgattatgaacttcactcgtgggatggtttctctaagaagaattaaagaagttcttgatactgaaccagatgttcagtttgatcctaatgcaccaactgcaccggaaaagggcagtatcgaatttgacgatgtttcttttacttatcctgatggcgataagccaactttaaagaatatttcatttaaggtgaaaccaggtgaaatggttggtattgttggagcaacaggatctggtaaaagtacgctggctcaacttattccgcgtctttatgatacgactaaaggaacaataaaaattggtggcaaagacttaaagacaattggtgaaaaatcacttcgtaatactgtttcaatggttttacaaaaagcaattttattctctggaacaattgcctctaacttgcgtcaaggaaaagaagatgcgaccgattatgaattaaaacgtgcttcagaaattgcccaagcacaggaatttgtcggtcaatacccggatcgatttgaccatgaagtagaagaaagatcagctaacttctctggtggtcaaaagcaacgtttatcaattgctcgtggtgttattggtcaaccaccgattttgattttagatgactctacttcagccttagatgctaagtctgaaaaattagttcaagaagctttagagcatgatttaaaagatacaacaacagtaattattgctgaaaagatagtatcagtgatgaatgcagacaagattttagttttagatgatggaaaattggttgctgaaggaactcatgaagaattactgaagacttccccaatttatcaagatatttatcgcacacaaaaagctaaagaaaagagaggtgaaattgatgagtaatattaaaaaagcattaaaatactttgccaagtatttaaagaattattggaaaggcgttacaattgttatcgtcttatctttgatttcgactttgagtcaagtgcttggtcctcttttcctaggaaatgctgttcaagaattgactaaggcggttaataaagtagctagccgtactcatgatttaagtagcttttatcaggctttaggatcaatggtgggtgtatatgcagcaggaattatcgcctcctttattgcatggatggtaatgtcaaaattcactgcaaatgctactaacgatatgagagaaaacttatttgctaagtttcaaagaatgttaattcgctactttgatactcatcaagatggaaaattattatctctatttaattcagacttagataatatttttaatgccttgaataatgcaatttttgaaattatttctcaaggtgcattattaatcggaactatcattatgatgtttatcgtaaatccaactatggctctgtttacggtagcaacaacgccattcattttgattattagtgtagttattatgaagaaggcgagagtttatttagataagcaacaagataaaattagtgatcttaatggttatgtaaatgaacagatcaatggtgaaaaagtaattattactaacggcttgcaagaagaatctgttcaaaactttaaaaaatacaataacgatgttcgtagcgctatgttcaaaggtcaattttattctgggatgctcttccccttactacaaggaatttctttactaaatttagctattgtaattgggggaggggcatggctgattgttagtggtcaagtcagtcaagcaattggtttaggcttaattgttgcctttgttgaatattcacaaacatatttccaaccactaacccaactcacttcaatttattcaatgacacaacttgctttaactggtgctagaagattggcaactgttgaagagcaagatgaggaaaatacggtgcccgatggaaaagttcttaaaggaatcaaaaagggcgttaaattagaaaacgttcgttttggctataacgctgataaagagatcttgcacggcgtttcaattgatgtcgataaaggcaagtcagttgctgtagttggaccaacaggttcaggaaaaactacgattatgaacctaattaatcgtttctatgatgtaaatagtggtaaagtaacttttgacggtgttgatgttcgtgatattacacttgaatctttaagaaataatgttggtattgttttacaggattctgttctatttactggaacagttgaagataatattaaatatggtaagccagatgcgagtcgagatgaagtaattgcggccgcaaaagaagctaatattcatgacttcattacgaccctccctgacggatatgatactcaagtttctgaagaaaattctgtcttttctactggtcaaaagcaattaatttcaattgctcgaacaatcttaacgaacccagaatttttgattttggatgaggctacttctaatgtagacaccgttactgaggccaagatccaaaaagctatggatgcagttatcgcgggcaaaaccagttttgttattgctcaccgtttgaagactatcttaaattcagataaaatagtagtgttgaaagatggaaatgtcattgaagaaggaaatcacgatgaattaattaagaagcgtggtttttactatggcttgtatacaaatcaaatggcatttgaataattttgaataataaattagagggacgctttccctctaattttggttagggggaaagtttaaaaagtgaagagaaagctacgattcttttctttatttattgtcttatttagcgtttttttactttcggcatgtcaaaaaaatactcgtaacgtttatcaagaagtgaaaaaaagtaatgaaattacttggggcgttaaggccgatacccgtttatttggtttgatgagcattaaaaccgggaaaattgagggttttgaagttgatttagcaaatgctttaactaaagaaatactaggaaaaaatgccaaggcaaactttgtacaaacaactgcaaaaacaaaaattccacttttgaaaaatggaaatatcgatgcagttttagcggcaatgacgattacgccagaacgcaaaaagcaaattgattttagcgatccatatttttatgctggacaatcacttcttgtaaaagatgattcaacaatcaagagcattaaagatatgaatggtaaaactgcattagctgtaaaaggtacaacagcagttgccaatgttaaaaaatttgcacctaaggctaaagtattagaatttgatgattatggtcaagcatttactgcgcttaaagccggtcaaggtcaagccatgactactgataatggtttgcttgccggaattgcaacagaaaacaagggctataaacttgtagggggcacctatactaaggagccctatggaattgctgtcaataaaggacagatccaaatgaaaaatgcaattaatcgtgcactcgtaaaattaaaaaaagatgggacgtatgatgccttggtaaagaagtggtttagcggtattccgggctttaatattaaagaggctgaaggtgaaaaataaaatttttacttgccttttttgaaaaaatattattaaatgtaatcaacatttaaatttaaaaagcgataaaaagaaaagtaggtaatctatttcttttagtgagttaacggtagtggaaaagttagcagaccctggattattgaaagacacttttataatgctgctggccgaaatcttttaagagagtaagtttagccgtaagcggtacgttatctagccgctggagcatggttgtgctctagtcaagttggtctttaattagacaatttaggtggtaccgcggaaaaaagcctttcgtcctgagtaaattaggagcgaagggctttttttctttactccaatcaggaaataaaggggtatgcgacagatataactacagaagttaattttaagaagttttagagtagaatggaaaagtgagtaaaaaagagaggggaagcacaatggctgcaattattgattttaagcatgtaaataagtactatggtaagttccatgctttaaaggatattaatttgagtattgaagagggtcaagttgtttcaattatcggcccgtctggttctggtaagagtactttgattcgtacaatgaatggattagagcgaattaattctggtactttgatggttactggctatgatttggcagataagcatacggatttaaataaaattcgtaagaatgtgggaatggttttccaacattttaacttatacgacaaccacactgtgcttgaaaatataactttagctcctaagattgttttgcatagaccagataaggaaaataatgatattgccatggatcttctaaaaaaagttggtcttgaagaaaaggcaaatatgtatccaagacaattgtctggtggacaaaagcaacgtgttgcaattgctcgttcattagctatgagaccaaaggcaattttgtttgatgaaccaactagtgctcttgatccagaaatgattcaagatgtgttagatgttatgaaatacgtagcagatcaaggaattacaatggttgttgtaactcacgaaatgggatttgctcgtgaagttggggacagattaattttctttgatcaaggtagaattttagaggatgaaaaaccagaagaattctttgcacatcctaagactgaacgtgcacgtcaatttttaagtaaggttattactgaaaagctaggtggctaaaatgaaaaaatcaactaagatttttattttgcctctggtactagctttattagttactttgaccggctgtgccaagaagcagaaatcaagtaacgtttatgatcaggttaaagagagtaagacaattacttggggagttaaggctgatactcgtttatttggtttaatgagtattaaaactggaaagatcgaaggttttgaagttgatttagcaaaagccttaactaagcaaatgttgggtaaagatgcaaaagctgaatttgtacaaacaactcccaagacaagaataccgctactaaaaaatgggaatattgatgcaattttagcaacgatgactattacgcctgatcgaaaaaaacaagtaacttttagtgaaccatattttactgctggtcaatcactgcttgtaaaagatgattcttcaatcaaaaacgttagggacttaaacggcaagaccgccttagctgttaaaggaacaacagcagttgataatgttaaaaaatttgcgcctaaagcaacagttttagaatatgatgattatggtcaagcatttactgcactaaaagcaggtcaaggtcaagctatgactactgataacggattacttgccggaatcgcgagtgaaaataaaggttataaattagtagggggaacctacacaagtgaaccttacgggattgcagtagaaaaaggtcaaactgattttgcggatcatattaataaggcactaaatgaattaaagaaaaatggaacgtatcatcgtttattagttaaatggtttgacggtattccaggatttaatattaaggaggttgaaaattcgtgataggaattttaacaaatcattggtctgaattcttatcaggcttttggaacacaattttatgtagtgtaattgccctattctttagtttgatccttggagtaggctttgctttgctagaagttgcaccaaataagtttggtagagcagtagcacatgtctacattgaaattttccgtaacattcctttgttagttattacaatgattttttatctggttgtacctcaaatttggttcaaggtatctggatttgcagcaggtacaattggattaacattatatacttcagcatttattgcagaaacagttagagcgggaattaactcagttggtgatggccaaatggaaggtgcccgctcaaatgggatgacttatacgcaagctatgcggtatgttatcttgccacaagctttaaagattgtcattccgccattaggtaaccagttcattaacttaattaagaactcatctgttttagcctttgtagcaggttttgatttgatgtatcaagcagacgtaattgcattctcatcatttgaaacaatcaatacttatgttgttgtagggttattttacttagtactaaccctcccattaagttactacatgcgtcacttagaaaagaaattagcctagaaaggagaaaaagatggaaaactttattcatgcatattcttggattaacattcgctttctcttacaaggtttgtgggtgaccatatatgtatctttgatctcaattgctttaagctttgtattaggactagtattgggttttatccgttacgtgaaaattaaatatctttcagcaattgtgggatttgtaattgatattattagaaacctgcccctattgttaattatcttctttacgtattttggattaccagaattagggattattaccaatccaacggttgcttctattattgctttggtagtatttgaaggggcaatgctagctgagattgtgagaagtggtattgctgctgttgatccgggccaaatggaaggtgctcgctcaaacgggatgacatatatgcaggcaatgtatcatgtaattattccgcaagccctcaataagatgattccatcccttttatcacaatttgtttcattagttaaggatacgtctttagcaacaattattgttttgccggaattattattccatgcacaaattatttatagtcaaaatactacttacttaattccaatgtatgtaattattgcgattatgtacttcattgtttgtttctcactttcaatggttgctaagcatttgcaaagtaaatattaaaaaataaaccacatgaaaaaattcatgtggtttttattatgccttttagtagagctaattaactgtatatccaaattggtaaaaaaatgaactggtttggtattttttgtatttttattttaaagaaaggaataaaatacaggtataaatatataagaaaaaataaaatgtgaggaaattaattatgaaaaattggggtttaacagccatgtacattgtcgtaatgttactaggcttctttgaattgtatcgtaccttcagattttataagtgggataaaaaggcaaaacaacttgcaactgcaccttatgtaatatattttggaaccttcattagtgcagtattgattatcgtaccagtcatgttcttgttaggggatacgaatccttatattccaaactttttatatgttattctaggaattattttaattatcgtatcacttttaatgtactggcgtggacatcaaatggctaaaaagttgggcaaggatgatagtaatttagccgtttggcaaatttatttaattagtacggtaattctatttagtggatttgtaaatttctttaagtaaattatctagtaaaaagagcaactacacatgaaaatatatgtgaagttgctctttatttactatattttaattgctaaagcttcatatggctttaactcaagtgttgaaggaagagtaacaatctcttcatcataattttgaattaaaatttcaccgtcacgatctatatattccgtaggaatttcaacctttgtttctttgccatagaagttagcaaagactaataatttttcgtcagagttatctaagtagcgttcatatgccataacctggggatgatccatcaaaagaggcttaatgtgaccagctgaaattaattcttcgctttttctaagtttaattaatttttggtagaaattaaatatttctccttcacgtaattccttttcaccattcaccttgtcttggtcagttggcatcagccaaggcttactttcactaaaaccagcatatttagaattatcccaatgcattgggactcttgaattatcacgagcttttgattgaacgatttcaaaagcttcttttttattcatccctttagcaatgagggcatcatatgcatttagtgcttcaatatcaacataatctttcatcgaagtatagtgtggatccatcataccgatttcttcacccatgtagatatagggtgttccacgcagtaggtgaagagcgagagctaacatttcagcagatttgtcatgatatttaccggtatcgccaaaccgatttaaagcccaaggctggtcatgattgttccaaaatagagcttgccaaccgccaccttggtcaattttgctgttccaagtaagcataatgtcttttaattttttgaagtcaaaagacatctttgaccacttttctccatttttgtagtcaactttgagatggtggaaagtaaataccattgagagttcatgatcttgtgggcgagtataagcaattgaattttcaattgtagtagaggacatttctccaacagtgacagactctggatcttgaccaaaggacttagcgtttaattcttttagatattgctgcactactggagtatcagtatagagtgatttttcttggactggatcagttgaatcaactaggacagtatcttttcccgttacattaattacgtcaaagcggaaaccgtgaacacccttactgcgccaaaagtttattacatcaattaaggcagcgcgaacctctggattgtgccagtcaagatctgcttgagttggatcataaagatggaggtagtaataatctgtgtcaccaaattttgaccaggcagggccaccaaatttagattgccaattgttaggcaactttccatctttaccttttctgagatagaagaatttttgatattttttatcaccagcaagagcctttttgaaccattcatgttcagtagaacagtggtttaagaccatatcaagcatgacattaacatttatatcttttagtttagccactaattcttcaaagtcggccatagttccaaagcgaggatcaatttttttataatcagcgatatcatagccgttatcattttgcggggaaacaaaaaatggattaaaccaaataaagtctacatttagcttcttaatatagtcaattttttggataattccgcgtaaatcaccgataccgtcattatttgagtcataaaaagattttggataaatttggtaaattactttattgcctaaattattcattgatatagtacctttctaaaacttaatcttttttctacgagcaaaatcaacaaatttgaacttatcgggtctgtgataagacaaagttaattgaaatttagttgtattagctaagtaattacggcttgcaactaaaactgcaagatcattgtcgagttgaagtaagtcttgaattcttttatcaactttgcagacagaaatttcttttgttgcgtatgaaatatctaatttttgtttattttctaaatagtcatagatagaagtctcagcagcttcctgtggaagagaattaactggaggggagagtaaatagtcacaatccaatacatctgcctgcccatctattaaacgtaatcgttcaagatgaaaaccgatgctattttcttcttcaggaaaatactttataaattgcgctggtaatttatcttctttttgtagaagtaatacttttgtctcagcttttaatcctaattggttattcaattccgcaaaactagtaattccgaaaattggaaaagtataacgatctaaattcaatacaattgaaccttttcctctaattttttggatcagtcctaggtcagttaagctgttaagagcttttcgaattgtctcacgagaagcgccatataaatccattaattgatgttcacttgggagatagtcgccaggcttatattgttgatgtttgattttatcaactaagtcttgagcaattactccaactttagattgagccataaaaaaccctcctttgtctttaattatatacacttgattagacaagtaaagaaaaacatttttaattataaaatattgatttaaaagaaaagtaagctttttcataaaaatatattgacaacttgtacagacaagtataatattaaaatcaagataaatgaaagcggatactttcaaaggggagaatgaaattatggtacaagatactactaatttattagctccagcaactggagcggttattgctttagctaaaacttctgatccaatcttttctcagggaacaatgggagatgggtttggattaactccaaccattggaaaggttgtagcacctgtttcagggaaaatcagtatggttgctgacactaaacatgctgttggtatcgtaactgaagaaggactagaagtgttagttcatatgggtgtggacaccgttggcttaaagggagctccatttaccattaagattgaaaatggtcaggaagttaaggctggccaagaaattgctgaaatgaacttagatgaaattaaagccaaaggattagatacaacaattatggttttaattactaattcagcagataagctttcaggactagatgtaactgaaggtgaagcaaaagctggtgaagtagtagcaactgcatacttgaaagaagcaggagctgaggatacttcaagcaaaaagttatcttatccagaattagctacctttattattaaaaatgttggaggtaaggataatgttaataatgtgattcactgtattacacgtttgcgtttttacttaaaggatgaaagtaaagcaaatgatgaagctttgaaaaatcagcgtggaattttagatgtaatgcatgcttcgggtcaatatcaagtggtaatcggtaatgaggttactaatgtttttgataaagtagttaaacaattaggacctttagatagtgaagcagcgccagctccagaagatgacggtaaaaatccagtttcaagagctttcggtaatttaatcggttttattactggctcaatgagtccgattattggagtaattgctgcagctggtattattaagggtatcttagcccttctaactcttcctcaattaggaagtttgcttagtgtaaagagtacagcttatattacaacgagtgcaatcgccgattctgcattcttcttcctaccaattttagtaggatattgtgcagctaaaagattgaactctgatccgatcattgccgcagttattggtggagtgcttgtttatccgcaattagttgattggggtaaagctttcaagaccatgtttgaaattggcggaattaagtttgagttcttgaactatacttactcaattttcccaatgattttagctgcatggcttgctaaaaaatgtgaagactggcttaaaaagtggctaccatcatacttacaaatgatttttattccattaattactgttttagttgtatcagctttaactttgatggtaaccggtccaattattcaaggtgttgctaacggtattgctgtcttcattaactggttagttcatgcatctggctgggttggcggattcattattggtggtttctaccaagtattggttatctttggtcttcactggggtgttgtgccacttgttgctcaacaaattgctggaactggtgaaagtgcattaaacgcaattatttgttcatcaatgattgcccaaggtgctgcagtattagctgttgctattaagtctaagaaagaagacttaaaggaattaggttttgcttcaacaatttctgcaatgtgcggtgtaacagaaccagccgtttatggtattagtttaagatataagaaagtatttatttctggatgtatcggttctgcctttggtggattagttactggcttaatgcacggaacaatgtatggctttactggtggtttgattggattctcatcattcttcaatccaaaacatccaactgatttatctagtttctacacattcttaattgctagtgctgtaactattgtagtttcatttattgtaacttgggtatggggctacaatgacaagatggtacaaggtgctaaggtagcaaagaagaagagaccaggtagtaagtaatataatagaaaaaattatggccattatttgatcttagaacgggcaattagtagatttgataaccaaattaagttgataaaattgataaaacagcgttgataattcagcgctgattttttgaattcaatagttgaaaatattaaatcttattaatataattaataataatttaattgtgtcgtagattgggggaaaggctatgatctttgaaaagcttttttctaaagaaaataaaaaagatgagattgttagggtaaaaataagtgacgaagaattcaacgaattgaaaataaaattaagtagcggggatgtaacagttgaacaaggagaacgttttgcagttaactttatcggtaaacggcactacttacctattgttcaattggaaaatggaagactacagcttaagcaaagaattaatttaattgacaatgatgaagctcatcttaaagtcgttgtaccagcagatgtaactttggatcgtcttgatgttcaaactaatagtggtgatattgaaatcgttgataccaaagtggaaaaagcatatcttaaatcgactgagggaagagttagggtaagacgtgttgcaattgctgaatctcttctagaatcgacagatggtaatgtaaccgtgagaaacagcgatttagctgatgggaagcttgctacatatgatggagaaattaaagtctcaggatctaccttatctcaaatttcattgaatgttaccgatggagacatgaatttaactgacgtaactattgatggtggaagtgcaaacttaaaggctggtaatttcaccttagatcatgctgtctttaagagcgattatgagattaataatattgaagggaataatactgtatggagtgcaaatttaaagtacgcccgtgtcaggacagctaatggactaaataatatttcatttgatccgcaaccatctggagtgatcttaacaatgacaacagtagatggagataatgtggtggaataggagaagaatggtgaaaagagagaaatctaagcagaaaaatttaggaatttatagtagcttgaaatcagttattattaatacagtctcattctttgtaatgagttctatagtagtgggaatttctaattggagtgaagctcaaagcttaatactgaaaacgtcagaatatcttggattaataggtggaagtctgattggtggaattataatgagtttcttttttggtgaaaaataaccccgtggaaaaccacgaggttatttttatttgactgtacttaaaactgaacgaatcttcgtagtaagcatatcgatagcaacatcattttctccaccttctggaacaatgatatcagcataacgcttagttggttcaatgaattgattatacatgggcttaaccgttgctaagtattgattaattactgattctacagaacgtccacgttcttgtgtatcacgctctaatcttctgataaaacgaatatcatcatcagtatctacaaagactttaatactcattaaatcacgtaaattttcttcgcctaaaactaggataccttctaagataataatatcagccggttcagtgtgaattgtcttttcacttcttgtatgagcggtaaagtcataaactggcatttcaactgccttatagtccattaattgacgtaattgttcaacaagaaggggcatgtcaaaggcatcaggatggtcgtagttgatttttttacggtctgccattgataagttgtcgttgttcttgtagtaagaatcttgcgtcataattaagatatggtcgtcttgttgtaattggtcataaatttcatgagcgatggttgttttaccactaccagaaccaccagcaattccaatgataatagggcgtttactttgcacaataaaatctccttttttaaactattacaataataccttaaaattatgcgctatgatagctttctgagcaataatcttgacaaatatgttttttatagtgaaatattttggaactagttaaaaataaatatcttgttcactattaatatttataaaattaattctctttcaaaaaaatatatatttactagtagtacgttatagaaaaagaatactaaatcagtaatcaaattgaccaatttggtattttttgattttttagatagtaaaagatggtaatatttaagacataaaaatgttattaattgttttagaggagagaataacaatgaaagaaattaaaaaagaaaatattgttaagaaagttactttaactgaagaagaaatgagtgaagttactggtggagctagagtaaatggatttgttggtggaaaaattagtaaaaatatattttactggacgcgtaatatttggaaataaaaatgttattagtatatgttcttttaatgcttacttctggaataactgacttatggatattctttagaatttctcaagttgcagctagcaaaaaaaatattttgagtctaggtgcagtggtactattacttcccattttatgcgggggcgttgtcgaactagctacttttttagaaattttatttttcatattttattttagaaaaagtaagaaaaaggatgtggctactggatcaattttaattgtgggagttgcagattctataatagatataataactagtatcttaggagaacttttgtctattgaggatgaaatttatcttaatttattagtaccaattgtcgttataagtcttacagtttttataattgaaatattctacaagcatcttcacgcatatttaataagtgaaaatcgcaatgtatttattggacttctgtcctacttgtatgtctccactactttaacaacaattttttacagacaaactaagaagattacatcgttaagcatattttttacaatttttgtattaattcaagtagtctttgcaatagccacttacggggaactaataaatattcaaaaacatcttttgaaaaagtcccaacaagacaaactaataaaagagcaaaaacaacttcaagaatacacgcgatacttagaagagagcgaagatgaactgcgtgcttttcgccatgattatcgaaatatgtttaattcattaaaaatcagtgcacaagagggagatacgaaggaactaattcaaaaactagacgaatatactaagactaatttaaatgccaaagcatttgaaaagtatagagatgttaatcacattaaagtaaaatctttgaaaagcattattattgctaagttaacagaaatgtatggatcaaaaatcccatataatttcgaatgtagagatgatattactaaaatccctaacaatattaatgaattggatttagttagaattattggcatcagttgtgataatgcaattgaagaaagtaaagcattattgaaacagaataaaaaagctcatattgaaattatgattagttcaaatgaggatggcgaatttgaatatgaaattcagaataaaagaagagattcagaaatttcacttaaacaaatccagcaacgtggttattcaacgaagaaaagtcactctggcatgggtttagccaatattaatagtattaagaataaatatgaaaatatgacgatttcttatgagataccgaagggatactttgatttctatctcgtaattgaaccagaggagctaattaacagttaatgaaaatatagaaatttatagaagaaatagaaaaaagcttatttagaaagttaaacatggaaaataagctttaatttaatatttacttgttttgctttccttccttagataaacttatgtttgtatttaaggaggtgaagaaatgattaaaacacaagtagttaagctaaaagttaataaaacaatgcaaaagcatcttgataatttgtgcgactatcgtaggtattgctggaacaaaggattagaaacttggcaattaatgtatgaagctcatacattaaataaaaaagataatcctagccctaatgaacgcagggtccgtgatgaattagtagctaagaaagaagattggcagtatgaattatctgcacgttgtcttcaattagtggttaaagatttggctaatgcttggaagaacttctttgataaggctcaatctgattggggtaagcctagtttcaaatcaaagaaagcccctagacaaagctttaaaactgatcgagctaagattgttaatggcaagcttcgacttgataaacctagaagtgtctcaaaagaagattggtttgatttgtctagttatggggccttaaagatgagtgaagttaaagtagtaagtatcttcaaagaaaaaaacgcttattatgcggctcttccctatgaagaaaagattgaatataaatctaaaactcatcaaaagacagcagttgatgtcaatgtcggtcactttaattacacagatggacaaatcaatgttttgcctgttaaactgcaaaaactatataaacgtatcaagcattatcaaaggatgctagcccgtaaaagagaaattaatgggaaatcagctattaaatcaaataattactctgcagtgagaaccaaactgcaaagagattatcgcaaggtagctaatattcaaaatgatcttttacagaagtttactactaagcttgtagataattacgaccaaatcgtaattgaagacttagcagtcaaagacatgatgatgacgcacgtagcttcaaaaggtatgcagaggtctttatttagtaagtttagacagatattaacttataagtgtgattggtatggcaaagaattaatcttagctgataaaacatatccatcaacacaaagatgcgctaaatgcggatacgtcaaaacgggtgatgaaaaaattactttgcaaggcaatcaaaagcatggcaccaaacataatgagtatatctgttataagtgtgattacagtaatgatcgagatgaaaatgcagttttaaaccttttagctttagcaagataaaaaaataaaaacaaaggggctggctaggccctaaagctgtgagagctagtcaatgtgattactcctaaatggaatatcagaatactaatgaagacaacagtaaataaaacaaagaaagggaaaatatatctttctgatatgtagaaaatacatattcttctacatatttccatgttttatatagcagtgaaaaaatattgaaatatccagtaattatttgtgatgatgatagaacactagcaaataatttagcaaacaatgtgaaatacgcagctgagaatttagtggaagacaatacagcttatgaaaatgtggagattagtgtagagcaagttgccactacctttgagcaagtcgtaagttatgtagtggctaaggatattcaaaatgcaatttacttcttagatattgaattaagtcaaaattctgaagctaagaatggagtagatttagcagaattcatcaaaaaacaagatccgaatgctcagattatttttgttactgcttatgataaatatgcccccttaacttatcgaagacgaattggtgcaattgattatattaataaagcactagaccaaaatgatatgatgaagcgtctagaagaaacaattactggggcgattcaaagtattaacaatcttacaaagtctggaagaaaagagcttgtttataaagtaggccgcaggataaataaggtagaagatactaatatctattatcttgaaaatagccctacacaacataaagttacgttaataactgaaactggttcagccgaatttagaagtaatatttcaaaaattagtgatgaaaatgactttcttgttaaagtatctcaatcttgcgtagtcaatccaaataatattgatagcattgatttttcgaaaaagaccataacatttcctaatggtgacgaagtaatatttgctcgtagttgtagaaaaaatgtcaaaaatttactaagtaaatatccagaaattaacgttaaataaaaggtaagacttatgttattcaaatataaatctgtttatgtacctcaagtagatgagatggattgcggagttgcttgtttagcgatgatcttaaaacaatatcattctcgtatatctttagctcatttacgtcatgaagcgcgtactaatcttgaaggaacaactgctttagggttagttaaaacagcccagaaatttaatttaaaaacagaagccgtaaaggcagatatgtctttatttaatgatgacggtattcagtatccttttattgctcacgtacttaaacagggagaattgcttcactattatgtggtgctaaaaaatactaaaaattatttattaattgccgatccagatccttcagttggtgtgataaaaatgcctaaagataggttcgctcaagaatggacagggattgcactctttatggttcccaatgaaaactttgaaccaattaaagaaaagaagaataacctatggtctctctttccatatatgtttaaacaaaagcggctaatgattaatatcattctagccgctttattaatgaccataattagtatctgtagttcatattttgttcaaggaataattgatacttatattccaagtggtacttatcagactttatcaatcttagcagtcggattgttaattgcttatgtctttaattctatcttctcctatggacagaattttttgctaaatgttttaggacaaagattaagtattgatttaaatcttcaatatattagacatatttttgaattaccgatggaattttttgtaacaagaagaacgggtgaaattacttcacgtttttctgatgcaagtagaattattgatgctttggcaagtacggttatctcgcttttcttagatctatcaattgtaatcgtaatgggattagtattagcggctcagagtatgactttgtttggaatcacattattggctttacctatttatgcagttgtaattctaggttttactaaaaagtttgaaaaattaaataatgagcaaatggaaagtaatgctgttttgagttcttcagttattgaagacattcaaggaattgaaacaattaaagcattaaatagtgagaatacaaggtatagaagaatcgatagtcagtttgtagattacctaaaaaaatcttttaaatacagcaaaactgagagcttgcagacagcactcaagacatttattcaattatctcttaatgtaattattctttgggttggtgcaaaagttgtaatgcaaggacaattgagcattggtcagttgatgacttttaatgcgttgctggcatattttattgatccactgcaaaatattattaatctgcaaccgcgacttcaatcagctagtgttgctcaaaatcgattgaatgaggtctatcaagtaaaaagtgaattcaatcagaagactgctattgaagattgtaagctcctagaaggaaatattgaatataagaatgtggattatcgctatggttatggtgcagatgtcttaaaagatattaatctaaaaattaaccagggcgaaaaattaacgattgttggaatgagtggatctggaaaatcaacaatggttaagttgttagtagatttcttttcgccaagtaagggtcaagtcattttaaatggccatgcaacaagtgagattaataagcatagcttgcgatcatatgtgaattatgtacctcaaaccccatatatcttttctggaacagttagagagaatttgttgttaggttgtaggccagatatcactgaagaagatgtaatagaggcttgtcagattgctgagattgaccaagaaatagctaatctacctttgcaatttgaaacaaaattagatgaaaatgcaaaaattctatctggtggacaaaaacaaaggttaacaattgctcgggcattattatctcctgcaaaggtatttatctttgatgaagtaacaagtggcttagatacaattactgagaagagagtaattgataatttgatgaagctcaaagataagacaattatttttatcgcacaccgtctggcaattgcggaacgagcagataaggttgttgtaattgatcgtggccagatagttgaagaaggcagtcacagcgaattgatgaatatgcatggcttttattatgacttagtgaagggataggtgagtacagatggatgcaaagaattatgaaagtaccgaattctattcctataagtatagaaatttttcgactatgattattattccagcagctatttttgtcttacttttatttgttggatctttttttgcagttaggcagaatacagtctcttcggttggcgttgttgaaccaacggttgtaattaagcggaaaaatgttaactatgatgagggacaagtcgttacgaaatatggtcaaaagtgggtagctcatgttgatcaaggtggtgggattagtttaatgcctgttatgaaacctaaaagcaaagtaaaaattgtaacttatgtgacaagtgataaaatctcgactattaaaaagggacagtcgttaaccttttctgtacctactggagatggcttaactagacacttgactggtaaggtaaaggaaattggagtctatcctgtgaacatgaataaacaaaatatgtacgaaattatttcgactgcaaaagttaatgatgagaatattaaatatgggatgcaggggaatgtgacgataatgaccggtaggagtacgtatttaaaatatcttttggataaggtaaggaataataagtaaaaaatactaatttagttaataaaagtaattttagacacaaatagaacaatattggtcaattttatatcttaagatgataactttagtaagctatgcatataaataaaattttaggaggtttctatcatgaaacaatttaattatttatcacataaagatttagcagtcgttgttggtggaagaaataattggcaaacaaatgtgggaggagcagtgggatcagctatgattggggctacagttggtggtacaatttgtggacctgcatgtgctgtagctggtgcccattatcttcctattttatggacagcggttacagctgcaacaggtggttttggcaagataagaaagtaggattttgacaatgaaattaaatgacaaagaattatcaaagattgttggtggaaatcgatggggagatactgttttatcagctgctagtggcgcaggaactggtattaaagcatgtaaaagttttggcccatggggaatggcaatttgtggtgtaggaggtgcagcaataggaggttattttggctatactcataattaaactatagtcaattaaagtaaaacagtgatgatttgatatttagcactgcattactttattcatagattcattagtaggtagtttaaatgactaaacattataaaattattggtctaaggatattgtcatgggtaattacgattactggattgataatatttatcggaaatgttcatgagtatggcttacattttacttataatcaagtattggcaataattattgtgattttacttttagttactactatgtatttttcagttacacccaaattattgaaatggaatgaaaaatatgagcttgtatggtggttatgctatttatgtgctcctatatatctctttttaactaatttatataattcaacagatcttggttatactatcaagttttggcttttctttggtggaggagcagctttaataatcataagtaagtatattttgaaaaacaaaaaataaagtctaaataatttatctatttcaatcgtatataaataaaaattagaataccaaattggtctgtaaaacgactaatttggtattttttatcttatgaaattttgaacctgataaaatttttaataaggtaaaaaagagagcgtgataaaaatggaaataattaaaaataatgaaaagatagcatcaaataaagaaaaatggataacactaattctagctgctgcttttggatattcaatgaataaattgttttcgctgattgtaaaattaaattgaacacttgataaaaaataaaaagtccattcggacctgtttgatagaatgttaataaccacaaaaactttctattggaggtcaaaatggactctttacattctaccatgaaccagcacgttaaaggcaagcatttatcatttgaagagcgagttattattcaattgcgtttgaaagatggctattctttgcgtgcaattgcccgtgaacttaactgttctccttctactatcagctatgaggttaagcgtggcactgtaaaactgtatcatggtaaagtcaaaaaatataaggctactcaagggcatgatgcatataaagctcatcgtaaaaattgtgggcgcaaatcagactttctcaggaaagctcaattcatgcgctatgtccacaagcatttttttaaagatggctggtcgcttgatgtgtgcagtaatcgtgctactgctgttggcgaattcgctagcagcgatgttgtctgcaccaaaactctttataattacgttgatcaaggcttattaggaatttataattacgacttgccagagaagcttaaacgcaatactaagcttcatcgtattcgcaaaaataagaaaaaacttggcagaagcattgaagaacgtcctaaagagatcaataaacgtaatgaattcggtcattgggaatgcgatttagttctcggacataagagcaaagatgatgaggtactgctaaccttatctgagcgtatgagtcgtgagtttttaattcttcgtattcctgacaagacttctgtcagtgtcatgcaggcctttaaagaactccaaaggcaatacagcgaacattggaatgatatttttaaaaccattaccactgataatggctcagagtttgcagatctttccaacctagaaaaagtatccaatacactggtttactatgcccatccttacacttcttgtgataagggaacagttgaaagacacaatggtcttattcgcagattcattcctaagggagaagcaatagctaactattctttacaagacatcattaatattgaaacctggtgcaattctttgccaagaaagatactggcctatcatacaccagatgaaatctttgaaagagaattagatctaatctatcaagcagcttaactaaaagtgttcaatttattattgcaatttgcgagattatttttgttactgcttatgataaatatgcccccttaacttatcgaagacgaattggtgcaattgattatattaataaagcactagaccaaaatgatatgatgaagcgtctagaagaaacaattactggggcgattcaaagtattaacaatcttacaaagtctggaagaaaagagcttgtttataaagtaggccgcaggataaataaggtagaagatactaatatctattatcttgaaaatagccctacccaacacaaagttactctaataactgaaactggttcagctgaatttagaagtaatatttcaaaaattagtgatgaaaatgactttcttgttaaagtatctcaatcttgcgtagtcaatccaaataatattaatagcattgatttttcgaaaaagaccataacatttccgaatggtgacgaagtaatatttgctcgtagcttcaaaaaacatgtcaagaatttactaaataaatatccggaaattaacgttagataaaaggtaagacttatgttattcaaatataaatctgtttatgtacctcaagtagatgagatggattgcggagttgcttgtctagcaatgatcttaaagcagtatcaatctcgtgtgtctttagcacatttgcgtcacgaagctcgcacaaatcttgaaggcacaactgcgctgggactagttaaaacagcacagaaatttaattttaaaactgaagccgtaaaagctgatatgtctctttttaatgaggatactattcaatacccttttatcgtgcatgttcttaagcaaggagaattacttcattattacgtagttcttaaaaatactaagaattacttagtaattgccgatcctgatccatcagttggcataataaagatgcctaaagataaatttgctcaagaatggactggtattgcgctttttatggttccgaatgaagattttgaaccaattaaagaaaagaaaaataacctatggtctctctttccatatatgtttaagcaaaagcggctgatgattaatatcattttagccgctttattaatgacaataattagtatttgtagttcatactttgtgcaaggaataatcgatacttatattcccgatggaacttatcagactctttcaattttagctgttggactattaattgcttatatttttaattcaatcttttcttatggacagaattttttattaaatgttctaggtcaaagattaagtattgatttaaacctccaatatataaggcatatttttgaattgccaatggaattctttgtgactagaagaactggtgaaataacctcacgtttctctgatgcaagtagaattattgatgctctagcaagtactgttatttcacttttcttagacttagcgattgtaattgtaatgggactagtgttagctgctcaaaatacaacattatttgggatcacattattagctttaccagtgtatgcgatagtaattctaggatttactaagaaatttgaaaaattaaatgatgaacagatggagagtaatgcagtactaagttcttcagttatcgaagatattcaaggtattgaaactatcaaagctctcaatagtgaagatacaagatatcgcagaatcgatagtcaatttgtaaactatttaaagaagtcatttaaatatagtaagactgagagtttgcagacggccttaaagacatttattcaactatctcttaatgtaattattttatgggttggagcaagagtagtgatgcaaggagagatgagtattggtcaattaatgacttttaatgcattactatcttatttcattgacccacttcaaaatattattaacttacaacctcggcttcaatctgcgagtgttgcacaaaatagattgaacgaggtttatcaggtgcaaagtgaatttaatgcagatacttctatccagaactcagctgctttagaaggaatgattgaatacaagcatgttgattatcgatatggttatggtactgatgttttaaaagatattaatctaaaaattaagccagatgaaaaattagcaattgttgggatgagtggatcaggaaaatcgacgatggttaagttactcgttgatttcttttcaccaagtaagggagaagtaactttaaatggtcatgcaactagtgaagttaataaacataccttacgctcgtatgttaactatgttcctcaaacgccatatatcttttctggaacagttaaggagaatttattactgggatgtagagctgatattagcgaagaagaggtaattaaagcctgtcagattgctggcattgatcaggagatagctaatttgcccctacaatttgagacaaagttagatgagaatgcgaagattttatcaggtggacaaaagcagagattaactattgctagagcattactttcgccagcaaaagtttttatctttgatgaagtaacaagtggtttagatacaattacagaaaaaagagtagttgacaatcttatgaaactaaaagacaagacaatcatttttattgcacaccgtctagccattgcggaacgtgcagataaggtcgttgtaattgacaaggggcagattgttgaagaaggaagtcatgaagagcttatggagcaacatggtttttattatgacttagtaaagggataggtgaggataaatggacgcaaaagactatgaaagtacagaattctattcctataaatttaaaaatttttcgacaatgattattgttccagctgctcttcttgtcttcctgatgtttattggttctttttttgcaattagacagagtacagtttcttcagtcggagttattgagccagtgactgtgattaaacaaaaagctgctaattatgatgaaggccaaattgtcacaaaacatgggcaaaaatgggtagctcatattgatcaagatgatgcagtaaatttgatgcccatgatagcagccaagaaaaaggtgaagataatcacttatgtgccaagtaataaggtttcgactattaaaaagggacagaagataaacttttctgtctcaacaggagatggcttgaccaatagattaactggtagggtgaaggaaattggcgtttatccagtaaatgtaaataagcagagtggctatgagatcatttcaactgcgaaaattaatgatgagaatgttaagtatgggatgcagggaaatgcgacaattgtcacgggtagtagcacttattttgaatactttttagataaggtattgaataagagatgaatttggtcagaaaatgcaaaattagtattaaagcctacaagtttaatccattttaacattacattatagctatttaatattatagatattgaaggttagcaaaaagctaatccaaagtttatattataatttaaggagaattatatattatgagtaaatttcaacaattaacaccagaagatttgatggaaactaagggtggtaaaatttatcatgcaaccccttggcaaatttgtaactctaagacccataaatgttgggctgataatgcagctattgctagaacgtgtggtagagttattgtaaacggttggcttcaacatggtccttggggagcaagatagtttttcatttttaagtaatagctacataaatactccatgatagttatcatggagtatttatgtaaaattttttagtaaactacagtaataattataagagatgaggaaaattatgaaaataaatgactctagtcttaaagaaatacttataaaagcaaagaaccaatcggatgtagtaactgatttaaaagctcaggagctaatagaaggagctcttgaaaaattagataagaaaacaaacgtgaaaagagtaatttttaatctaaagcaagatattaatatgtattctgtagcgcatggatttaaactaccagaaactctgacaaagttacagcttttattagataaagatcctgataaatgggctggtgctggagaaactttgtcactgactaatttttagaaaaatacttttattaatttaaataaataacaaaattaaggagtgctaaggagtactctacaggcctataggggggagataaagatggataatacacagcaaaaaataaaaaagctacttctttttcaattaatcattaatatcttctttgccatatggtgtatatattatgaaggtaaaaatatctttaaaaactggaatatttggaatccggtttttattttaagtggattggtaatagcagctattctgtttattttaagatcaagaggaccaatcttagctaatatttcaaaattagttgacataatctttttgccatttagttttatttatctttttaattttgtctgtgtggctcttggagattatcttaattctagttttttctttgatttattatatgtaattgcgccattatttatttttattccggtagtaaaagtagattatgaaaatattcaatctaatttaggacgaatactttctatccaaattatttgcgaaatttttgtattaactaattataaggtcgattctaataagattttagataatgttaaccgtagtcaaattatcttctctatatttttagtattatttgcctatcttgttttaaagggatggggctatcatttttacctgggcttaaaactaaacaatcaatttcagtggaaagtatttattcccattctactttttggcttctatatggttttcttcaatgcctttttaacaaccaatcctaaatcaattggagaattgatttggaaatggaattttgaatggttgaatccagcagaatcacagtattttggtagttcactagaagtattcttaaatgctgcggatgctggtattaccgaggaagtttggcgatatcttacaattgttattcttttagtaatgcttaaaaataataaacataagatatctttgacgattctaattagtagcttactgtttggattacttcattttaatcagctgctatcaccagacagaaatttaaccgatgtaattattcaatcgctaggagcagttggattaggtatctttttaggaagcttatttctatactcagggcagatctggctcaatgttctatttcacttcttatttgatttagttgtgttttcgcttactccacttagctttgtagggagcggcattttaactatctttaattcaccagctttagctcacgttataataacttcgggattatttatacttgttagcgtaattttaataacgggaaaaagaagaaaatgtgttgaaaataatattgagagattaataatgcacgaaaattaagtaccaaattggtcataaaaaagactgatttggtcttttttatctttagtgagtttttgaatgatagaattataaacaaggaaaggatgataaaaatggtcataggatatatgccaattattttacttttaataattgctttaggtaatattgctgtttcattaaaagtgcataagatagtcagaacatctgacgcctcaaatatcttagtgcttggaatagtgaccatggttatttttgccttaaaagatttaaatgcattttcttggagttcagcaattgcttgtgtttttatgagcatcgttgtttttaaagatttgtacgatgagtatcaaatacaaataaagaataagtctgaggaacagaactaatgggaaagtcattaacgtttagatgcatctttgcgggagttgctttttgtttacttcaaactctaggagatatattggttggtagtcaactaactctttggataattctgggaaatattctgtggggagcgatttttgcttacttaatgtttaaattattaaaaagaatgcaaatgcggaaggagcataaaaggaaaggtacagatgaaatttattgaagctagcaagaagaaagatgcccatactgaggaatggatcgtaattattctcagtgtgatctttgcatatttgattaataaactatttttatctttgactaatagtactagtattacagcaagtcttgtagttctaattgcgagcatgagtattttttcaatcacttactattatggtaaagataaactccaacaaagattaaaaagcaaaaagtaagaaccaaattggttgtaaaaagggctaaatctgttaaattatcatttttattaaaaaattatagtaaaattaataaatgaatgataatatttaaacaatataatcctttggaggacaaaaacatgaaaaatgaattggcacaagtattgaatgatttcatttcacttgctaagactcattatgatcgaaaaggtaacgaatacttattagaacaattagagattgccttagataagacgaataacaatgttcaagatgcggtaaacgaagcacgaacaacctatcaaaatgtgaatacgatttgtttagtaaaccatctccatttagaaaaagatgaagaggcattacttgaaaaaattaaagaaatttcaatgagtaaaggctggcttggtggcttaaacagctggaatactaccaatacttggcctggaaggtaggaatgaaaatgcaagctttttattatgcaatgccaactttagcagtaattgtaattgcagcatatatttttacttcagttaagattcataagtttatctggttttcaccagttgtttatttagctttgataggaagtataggactctggattaaaattggtacaaatattttttctacctcagaaactggagttttcggattgcttacactagaagcaattctcttagagggaattattgaagaatatagatatcaaaaacagaatcttgaaaagaatgaagagtagcaaagtagctactcttttttaatatatcagctttatgtgcatcttttctcaaagtgaactaaaatggagctggaaaaaggaatagaagtgataactttgactgaaaaagatgatgaagacgatgagataattaaggtggctcaattatccgtcgaagatgcattaaaagaattaaatacagagcaagctggtttaactattgatgaagtacatactttgcagcaaacatatggaaaaaatgtttttgctaaagcaaaacaagaaccactatggaagaagtttatagctaactttacaagtttaatggcgattttactttgggtagcagggataatagctttctgcgcaaatttagtacaactaggaattgccatttgggctgtaaatattattaatgggatttttagtttttggcaggaatttcaggctgataaggcaaccgaagctttagcgaatatgttaccttcatatactcgtgttgtgagaaatggtaaagaagaaaaaattctggctaaagacttagtaccaggtgacatagtcaaactagaagaaggggacgatatcccagctgatattcgtgtgattgcggcaacaagtgctcaggtagatcaatcatccctaactggtgaagtaaatccagtgcataaagatacacatcgaattgaaaacgtcgaaaagaaaaatcatgctgatcttaataacatgattttttctggtacaaacatgatgaaaggaaacgttacaggtgctgttgttaagacaggaatgaatactgactttggtaaaattgctgaattgacacaaaatgttaagcaacaaaagagtccacttgaaaaagaacttgatactttaacgaaacaaatttcaattctagcaatttctattggtattattttcttcttagttgcaactttctttgtacattatcctttagtaaaagcctttgtttttgctttagggatgattgtggcttttattccagaaggattagagccaactgttacattgtccttggctggagcagttcaaagaatggcaaaaaagcatgccttgattaagcgtttatctagtgttgaaacgctagggtcaacttctgtcatttgttctgataaaacaggtactttaactaagaacgaaatgaccgtaaaagaactttggactttagagaagagctatcatgtttcgggtgaaggttatgcagtgcggggtcatattaaagaaggaccaacgcatatttttgcaaaagataatgacaccttgaaggaagtattacttggtggtgtttttgcagataatgcaagaattcaaaagcctgataagcaacatccgcgctaccaaatcttaggtgatccaactgaagcttgccttgaagttgttgcaagaaaaggaaagatagatgttgaagcagaagtagaaaagacaccacgcgttaaagaattgccatttgattcaagtagaaaaatgatgacagtaattcagagctccgatggtacacaccgtttcaatacctatactaagggtgccccaaattgtgtggttgataaatgtacttcttacctatgtgatggtaaaattcagcctattacccaggaaataaaagataagattatgagagcaaatgacggctatgctaaagatgccttgcgtgtcttagcagttgctggccgtaatcttgatcaaaagataatggataatttagatcttgcaacaattgatacagttgaaagagatctcaccttccttagggttaaccgttatgatggatccgccaagagccgaagtttataaggcggcacgtgaatgccgcaaggctggaattaaagttacgatggttactggtgactatggtttgaccgctaagagtattgctcgtgaaattggcttgactgatcctgataagccactgacagtcattactggggatgctttaaagacgatgcctgataaggagttaagacattatcttgaaggtgaagttgtttttgctagaatggcccctgaacaaaaataccgtgttgtttcgatgtatgaaaaaatgggtaaaatcgttgccgctactggagatggcgttaatgacgcacctgctttaaagaaagcaaatattggtatcgctatgggtggaacgggtactgatgttgcaaaagaagcagccgatatgattttgactgatgataattttgcttctattgtaggtgctattaaagaaggacgcggtgtatacagcaatattcgtaagttcttaatttacattttgaactcaaatatgcctgaagccgttccatctgttttgtttttactttcaggtggggcaattccattggctttgactgtaatggaaattttatttattgatctaggtactgacatgattccagctctaggtttaggacgagaagatcctgaaaaaggaattatggatcggcctccaagatcaccaaaggatcatttgattaataaagatgtcttggcaaaagcctttctctggtatggtttaattgcttcgataattgcgacagctgccttcttcattgcgaacttttatcgtggtcatatttttcctaatttgccagcaagcggctgggactatcgccaagcaactactgtaactttagcggcaattattttttgtcagattgcggcagtcttaaatattcggtatgctagacagtcaatgtttaacaaatatttctttaagaattcgatgatttttattgggatcattatggaaattgtcttactgctatgcatttcttatgtgccagtctttcagtcattttttggtacggagccgcttaatgcacatgattggattatgttagtatgtattccgttgcctctgattttaattgatgagttaagaaaatggattttaagaaaagagtcaaaaaataaataaactttaactgctagttttaactagcagttttttcttgctaaaatagtaaaaatacggaggtggcgaaagtatgaaaaaaggattagtaatagaaggtggcgcaatgcgctgcatgtttactgctggagtcatcgatactctgatgaaagcaggcattgattttgatggtgcaataggtgtatcagctggagctgcttttggatgcaattataagtcaagacaaatcggaagagttctgcgctataacgtaaaatatgctagtgacccacgtttatctagttggcaatcatggctaaagactggtgatttatatggagctgacttttgttatcgagaattaccagtagaattagatgtatttgataccgctgcttttcaaaaaaatcccatagatttttggtgtgtggcaactgacattaataatggtgaagcagtatatcataaattgatttcaggtaaagaagcagatttgcaatggattcgcgcctcttcatccattccagtttttgcgcggccagttgaaattgggagtcgtaagtattgggatggtggaattagtgattcaattccaattaaattttttgaaaaaattggctatgacaagaacgttgtcattttaacgcagcccctctcttatcgaaaagaagcaagtaaactatatccagctttagaattagtcttacatcaatatcctgctgtcttgaaaaaattaaagacaagagcaaaagattataatgatgtacttaattacattagaaaaaaagaagtacaaggcaaaatgttagttatcagaccgccttatcctttagaaattggcacaatggagaaagatccccaagaattgaggcgcgtataccaaattggtgtaaaagaagctaagaaaaatttacaagcaataaaaacttatttgagtgaataatcttcttgaatgacttgtctagattacatttcattcgctataattaacaaaagcttaaattttcagttttttaatagtaattgtagagggaatgaatgtaatgaaaaaaacaaaactgttaagctttttctttgcacttttgatgtttttctcactcggtgctacttttatcaagccagctcaagcggctagccaaaagcaagtagcagaaggtagtgtcttgaagaagattaaaaagagtggagaattagtagtcggtacatctgctgattatccgccactagaatttaccgcaagtgaaaatggtaagactaaatatgttggagtagatattgaactagccaaagatatcgccaaagacttgggcgtgaagttagttattaagaatatgtcttttgactcattgttagttgcactcgaaacaggaaaagtagacatggttatttcggcaatgacgcctactcctgaaagaaagcaaagtgtagcattttcaaaaatttactataagccaagtggtgaatatttcttagtaaataaaaaggataaagacaagtacacaagtattcaaagtcttaaaggtcaaacggttggagcacaaacggggagtaaccaatataatttagttaaatctcaaatgaaagattctaaattaaagggtcttgggaaaattaacaatcttgttttagccttgcaatcaggcaaggtttctgcagtagtagtagaagaattaattgctaaagcatatgccgaaaataatagtggcttagctgcagttcattcaaacttaaaagaaactcaagcgggaaatgcagttgcaattgctaaaggacaagatgatttagtagctcaagtaaataagacaattgatcaagttcagaagaaagatttgattagtaaagaatatttaccagcggctgctaaatatatgaagacagaaaagaaaagtaatacttttgccaagtacattccatatttctttaagggtatttggtacacaatcgtaattactattttttcagtaattattggtattgttttaggtatcattttagctttgatgcgtttatcaaagaatccaattttacactggcttgctgtttgctacattgaatttatccgtggtacgccgcaaatggtacaaattttatttgtttacttcggaattggatatttgatttctaatctttccgctttagttgcaggtattattgcgattggacttaattctggagcctatgtggctgaagatattaggtcaggaattgattctttaccaaaaggccagatggaagcagctcgctcacttggtttaagccgtcaaaaagcctttagatatgtcattattccgcaggcaattaagaacatttggccagctttaggcaatgaatttattactttattaaaggatagttcgttagtttcagtaattggagttgcagaactaatgtatcaaacacaattagttcaaacttcaacttataagggtgttctaccattatttattgccatgattatttactttattatgactttctcattaacgagattattgaatcactttgaaaagaggatgaagcgtaatgacaatgattaaggttgaacatttaaagaagagttttggaaaaaaagaagtcctcaaagatatttctgcaaatgttgagaagggaaaagttattagtatcattggtccatcaggttcaggtaagagtacatttttacgctgtcttaatgtacttgagacaccaacaagcggcaagataatttttgatgggcaagatttaacacatattagtgaaaaggaattagatattttaagagaaaaaatgggaatggttttccaaagctttaatctttttccaaatatgaatgtagttgaaaacgttaaattagctccgatgaaagttaaaggcgtaagtgaagaagaagctgaaaagcaggctttagaattgcttgataaagtgggtttgaaagatcgggctaagcaatatccttctagtttgtctggtgggcagcagcaacgtgttgcgattgctagagctttagcaatggaccccgaagtaatgctatttgatgaaccaacaagtgccttagacccagaaatggttggcgaagttttaaagacaatgcaagacttggcagattcaggtatgacaatggttattgttactcatgaaatgggatttgcccgtgaagtttctgatgaagtgtggtttatggcagatggatatttgcaggaacaaggaagtccagaacaaatttttgaaaatccgcaaactcctcgtgcaaaagattttctttctaaagtactttaaatattaatatttttttaaataagcactttctttttacaaggagagtgcttttttttataatagttgcgttagaaaagttaaaggggatgagtttaatgaagattagacaagctacaatggatgattatgatcaaattatgacaattttaaaggatggtgctaaccaactagcagaacgtggagttgaccaatggcaaggagactatccttcaccagatcaaattaaagaagatattgaaaaaggttttgcctatttagctgtttcagctgatggggaaacagtaggtgctatttctatagttgaagcaccagatcattcttatgatgatttgaaaggtgagtggcttctagatactgataaatatgttgtaattcaccgcgttgccattcattcaaagcacgcaggtcatggttatgctactaagcttttgactgaagtaattgattatattcgtgatcaccgtaaagatattgatagcattcgaattgatacacatgaaaacaatagcgcaatgcaacatctaattgataagatgaatttcactaaagtgggagaattgcatggagtttatcgtccagatgaaatttcatacgtttatgagaatgttagagaataaataaattttagctaggttgaaaaacctagcttttttgttgagtttaagcattctgttgacaggtactaatatgatagaatattcttgttgaatactgtaaattacatggagaaatcgatgagaaaaaattttaaatttaaaatagccgctgtttgtggactgctagctattttaatcggacttacaggctgtgctaacaataatagcaataagattactgttgttggatctagtgccatgcaacttttagctgagcaagctggaaatgactatcgtctgtctcatcctgacagtaatattgttgttcaaggaggaggttcgggaactggtcttagccaagtacaggcaggagcagttgaaattggaacttccgatgtttttgctgaaactcaaaagggaatagatgctaagaaattacaaaatcatcttgttgccgttgtaggtattgttcctattgtcaataagagtgccggtgtaagcaatttgagtaagcagcaattgagtgatatttttacaggtaaaattactaactggaaacaagttggtggtaagaaccaaactatcactgtaattaaccgttctaagggtagtggtactcgtggaacttttgagggtttagttctaaatggaaaaaagccaattcaggctcaagaacaagattctaacggtactgtacgtaaaattgtcagttctacaccagggacaatttcttatatctcattcccgtatgctaatgatgaaaatattcaaaaattaagtattgatgggataaagcctacgaataagaatgtcgagacaaatcgctggcacctttggtcttatgaacatatctatactaagggtaaacctaacaagaatgttcaaaaatttattgattatatgcttggaagtaaggtacaaaatgatttagtacctaaactaggctatattagtatcgataagatgcaggtcgaacgtgatagtaataatcatgttgttcaaaaataaagaataggacgttttgatgaataacaaagatcttaaaaaagtagttgagtctgctttagataagcaaaaagttcctcatgttaaattaaagaagataggtgcaagtaaggttgatgttgccagcttaactgagccatcaaaagaaacacgacaggaatattggggtaaagggttaacttactgcgccattattttaattattattttggttgcttcaattattggttttattggatttcatgggttggaaacttttactaaagatcatgtgaatgtttttcaatttttgacttctagtgattgggatccaggtgaaggaaagaatcatgttggagcagcagcaatgattgtaacttcattttctgtaaccttattagctgctttagtagcaaccccgtttgcaattgcagtagccttatttatgactgagtattcttctaaaaagggtgcacgctttttgcaatcagtaattgaattattggtaggaattccctctgttgtttatggattcttgggattaacagttattgttccttttattagaaatatttttggtggaactgggtttggtattttatcagcgactttagttttatttgtcatggttttaccgacaattacttcgctaactgttgatagtttaaaagctgtaccatctgattaccgtaaagcttctttagctttaggagcaactaaatggcaaacaatctataaagtgattttgcgagttgcctctcctagaattatgacagcggtaatttttgggatggctagagcctttggtgaagccttagctgtacagatggttattggtaatgcagttttaatgccagctaacttagtgagtccatctgctactttaactagtcaattaactagtcaaatgggaaacacagttatgggaacattaccaaataatgcactttggtcattagcgcttctattgttaattatgtctttggtctttaacttcttagtccgcttaattggaaagagaggacagaaataatgaatgcaaaaactcgtaataatattgctactgctggtatttatactttagtgagtattgtggtcataatcctctttgggattttaggtgatattctaatttcaggtgtgccgcatctttcatggcattttttatcttctgaagcttcttcttatcaagctggtggaggagtaagagatcagctatttaattccttatatttgttagttttaaccttaattatttcacttccaattgcgttaggggccggtatttatctagcagaatatgctaaagataattggtttactaacttgattagaacaacaattgaaattttaagctcacttccttcaattgttgttggtttatttggttatttattatttgtagtacagtttggatttggtttttcaattatttctggtgccttggctcttacattctttaatttaccaacgctaactagtaatattgaacaagctattgaaggtgttccgcaagcacaaagagatgcgggacttgccttgggcttatctaactggaaaacaattcgcgggatcgttttgccagcagccttaccaggaattttaactggtattattttgagtgctggtagaatttttggtgaagccgctgccttaatttatactgcaggtcaaagtggatctacaattgactatagtaattggaatccatttagtccaactagttttttaaatgtgatgcgtccagcagaaactttagctgttcatatttggaaggttaatactgaagggattattcccgatgcaacaattgtttcagctgcaacttctgcgttgttaattattgtggtgattttattcaatcttggagcacgtgccttgggtaatcatttataccgcaaattaacagctgctaagtcataaggagaaatttatgcaaaatgtaaatgaagccccgacatatattcatcaatttgataaagatgagcagattatttcgacgcaagaccttagtgttttttatggaggtagcgttcaaaagctttttaatgctagtcttcaatttaagaaaaaaactatcacagccttaattggaggatctggttcaggaaagtctacttttttacgttgtcttaatagaatgaatgataaagtggctcgagtagacggtgaaatttggtaccatggcttagatatcaataaaaacaatattaacgtttaccagttaagaaaaaatattggaatggttttccaaaagcctaatccatttccaaaatcaattagagaaaatattacttatgctctaaaagcaaatggtgaaaatgataagcaaaaattagatcaaattgtagaagaaagtttaagagcagctgctttatgggatgaggtgaaggacaagttagataagagtgcattggcaatgtctggtggtcaacagcagcgcttatgtattgcgcgagctcttgcattgaagcctgaaattttgctgcttgatgagcctgctagtgctcttgatcctgtttctacttctaaacttgaggatacacttaagcagttgagaactgactatacaatgatcatggtaacgcacaatatgcaacaagctagtcgtattagtgattacacagctttctttcatttaggtcatgttttagagtatgacactactgaaaatatttttactaatcctaaaggtgaaattacggaagactacattcgcggaagttttggataaggggtttactgtggaaaatattattacaagtaaagatgttcacctaagctatggaaatgttgaagctttacacggcattagcttagactttgaagaaaaagaacttactgccttaatcggtccttcaggatgcggaaaatcaacctttcttcgttgtttgaacagaatgaatgacgacatacctaatattcatattagtggtgagattaaatttgaaaataagaatatttatggtcctaaaatggatttggtagaattgcgtaaagatgttggaatggtgttccagcagccaagtccttttccattttctgtttatgacaatattgcttacggtcttagaattgctgggattaaagataaagaattgatcgaccagcgagttgaagaaagtttaaagcaagctgcaatttggaaagagactaaagataatttagatcgaaacgctcaagcattttctggaggacaacaacagagaatttgtattgctcgtgctttagcggttcgtccaaaagtagttttgcttgatgagcctacaagtgctctggatccaatttcaagtagtgagattgaagagactcttcttgaattaaagcatgattttacttttatcatggtaacgcacaacttacaacaagcctctcgaattagcgactatactgctttcttaatgagtggggacttaattgagtatggtaagacctcagatatgtttatgaatccgaaaaagcagattactagtgattatctgaatggacgttttggttaataaaggagtttttaagatgcatgaagtttttttagatgaattacgtaagttgaatactcgtttcatgggaatgggtattgatgttagtgaagcgattgaagaagcaacacaagcttttgttgaacatgataaaaaactagctcaaagcttagttaaagatgatcaaaaagtgtcacgtgctgctacaaaagttgaaaaaagaaccttaaaattgatggctcttcaacaaccagttgctagtgactttagaaatgttattagtatcttaaaagctactaatgatttagaacgaattggtgaaaatgctaattcaattgcttgggaaacaattcgagtaaagggaaatccccgtattccagaagttgaagcaattattaaatcaatggctaagaaagttaactttatgttagaccaagttttaaaggcctatgtacaaggtgatgaaaaattggctcgtgaagttgctaaaaaagatgatgaagtagatgaggattatgtaaaggctcgtaagttaattatttctggaattaagcaagatccagaagcagcggttgcttcttcaagctactttatggtaattcgtttacttgaacgtattggtgaccacgtcgttaatttagcacaatgggttatctataaaatgtcaggagaattagtagatttaaatactaaggatactgatgagatgaccgaattataaaattgaatatttttatgaagccggccaacaattgattgatatggttggtctacttaaaaaaatttgaatatagaaaaataagaaccttcaatttgagggttcttatttttatttaactttatatccttcagttgtaagcgcgtgcaaaaagtaaaaaagaaatctataataaaactataaattaagctgtaatactaagtagggggaagttatgcgcgatatagtacaaaaaaagaagaaacatcaatttccaacagcatatacagttatcattattgttctattattggtacagattttaacgttttttataccgtcgggtaattatgcaacgcttgaatatgatcaaccaagtaaagagtttgtaattacgaaaccaaatggtagcaagcataaagaagcagcaacccaaaaaactttagacaaatataaagttaagatcgatgttaaaaagtttactagtggaacgatctataaacccgtagctattcctgattcctatgaaaaaattaatcagaaaaagccaggactcggtggagcgatttatcaatttctttcttctcaggtaaacgggattgctcaaagtattgatattattgcctttgttttgattctaggtggttgtattggagttgttcatgcaaatggtgcaattgatgccggaatgcaggcactttctaaaaagattaagggtaagcaagttttattgattgttttagtaatgggattgatcgccattggtggaacaacctttggtttagctgaagaaacaatggctttttatcctatcttaattccagtcttcttattagcaggctttgataggatgacagttgttgcgacgatctttttaggtacaagtattgggacgatggcatcaactattaacccattctcgactgtaattgcctctaatacggcgggggtcaattttacagatgcattgccacttagaatttgtatgtgggcaacttgtgtgattgtagggatgatttatgtgattctttatgctaaaaaagtacaaaagaatcctaaagcttcatatgtttataatgacttcgctaaagaagatcaagaatatatgaatcagaatcaaagtatgcaagaaagtaaatttacttggcgtcaaaagttaactttacttgtctttgcgattgcctttatcgtaatgatttggggtgttcaacaaaagggatggtactttactgaaattgccgttgtcttcctagcaacgggctatattttcgcctttatttcaggcttaagtgagcataaatttgttgagagctttgtaaatggtgcggcagatttattgggtgtagctttaacaattggcctagcacgtgctgtttcaattgtgatggaagaaagtcatacaagtgatacaattatgaatttctttagtcagcaagtttctggaatgccaccattattgtttatttggtttatgtttttagtctacattgttcttggtttctttattcagtcatcttctggcttagccgttctttcaatgcctattatggcaccgctagccaacgtggttggaattgatcgcgcaagcattattgatgcctataattggggtcaaggatttattagtttaattgcaccaactggattaattttaatgagcttaatgatggtaaatattggattcaataaatggtttaagttttgctggaaactgttagttattgaatttggaatttgtttagcctttttggcaattggtttagttgtttactaactaagcaaataagtagcttttagtattttttatagttatgatgaagctaaagacattgtttaatattttaaggaggcatttttatggcttatccaaaaactaaaaaaattatgaatgaaattgttgctgatttaactcaaactcacatggttgttcaccaacaccattggtacatgcttggaagaggatttttgaaattgcacccatatttagatggtgtaatggaagaattagctgagcagcaagatggggttgctgaaagattgatcgccattaatggtaatccgatttccacctacgaagaagtattggaagaaactaacgttccagatcaaatcggtagttgggatttgtcaattgaagaaagattccaattaattataaatgcatacaaacaattgcgagatgattatgaaagagggatcaagattagtgaaggagaaggagacgactcaactaatgacctattgatttcctatcataccgcgatcgaaaaaagaatttggatgatgtcagctgaacttggtcaacgtccaggtgaaggtgaataggaaaaatatatttatgcaaagcattccgtgtatggaatgcttttttgctataattaaagtaaatattgccatacagggaaggaaataccatgaataaagttacaattgttgggtcaattaacgttgataatattatgcatattaagaaacttcctcaaccaggagaaacaatagcaatgtctgaattttcaaaagctgctggtggtaagggagcaaatcaagccgtagcaagtagtcgagcaaaaaatgaaacaatttttgttggacgtgttggggatgatgacaatggtcgctttatgcttgaacaatttaaagaaaatggaattaatgttgaccatgtagctgtaaccccaaaccaacaaactggacaagcctatattttgcttcaagagacaggacaaaattcaattattattcaacatggtgcaaattttgacgtaacagcagaagatgttagaaatgcgaaaagtcaaattgaagatagtgattttgtgattgctcaatttgaaacaccaattgaagcaacaattgaagcttttaagattgctagagaagctggtaaaattactattttaaatcctgcgcctgcccgtactgatattccagaagaattattagaattaaccgacttgattactcctaatgaaactgaagctgagagtattacgggaattaaagttgacagtgaagagtcaatgaagaagagtagcgagatttttcatcaaatgggaattaagggtgtaattatcacaattggtgaacgtggatcttatgtttcttatgaagatattgaagagattgttccagccttcaaagttaaggcagttgatacaactgcagctggtgatacattcttaggtgcattatctagtgaactaaagcctgatttaagtaacttaagagatggtgtgatttatgcatcaaaatcatcctcatttacagttcaaaaattaggtgcatttccatctattccaactagagaagtagttgaagaagctttgaaggagaaaaactaatgaataagacagagcaagatcaattaaaaaaagaagcagctactaaagcagctaagatggtagagcctaattctgttttaggagttggaacaggctcaacagttgcgttttttatcgatgcattaggtgaacgcaaagaaagagaaggttttagtttaaagcatattgttactacttctaaccgtagtaagaagcaacttgaaggactaggctttaaggttgatgagttagcagatattgatcaagctgatttaacagtagatggcgctgatcgagtagacgataatttagatggaattaaaggcggcggtggtgccttaactttagaaaaaaatgttgccatcaactcgaagaagattatttggattgttgatgaatcaaaactggttcaccatctcagcggtttcccgcttccagttgaagtattaccagtatctgctgaacaaaactttaaacgttttgaagcagaaggtttgaagcctcaatggcgtttaaatgatgagggcaagcgttatgtgacgcattatggtaattacataattgatttagctgctgatccaactcccgtaccacacggtttagctgattatttggaccacactgttggtgtagttgagcacggtttgtttttagacatgtgtgatgaagtcatcattgcacatagtgatggtacaattgaagataagaagagaaaataattattttttcaaaaactaatataatttttaaaagacttgatcagttcaagtctttttttgtaacaaatcttagttcataataaatatgatacgtaaatttagaaagaaggacctttatgtcaaaaaagcccttaattattagtacagatccaggtattgacgatattgctgcaatgacaatcagtctttttgcagatgaacttgatgttaaaatgattgttccaacctggggaaatgtttctttagctcacactttacaaaacactcttgatttagagaactttttacacacaaaagttcctgtagtcaagggcgctaatcagccgttagtacgtccagcaattagtgcagcttctgttcatggtgaaacaggaattgctggctttaaatttgaaaaagctaatgatgatttattagagccgggacttgctgctactaagatgtatgaagcaattaaaaacagtcctgaaaaagttactttattaggagttggtcctttaactgactttgcccttttatttaagcagtaccctgatgtggtagaaaatgttgctgaagtttatattatgggtggaaatattgggcatggaaaccatagtccatttgcggaatataatattgcaggtgatccagaagcagcacagatagttttccattccggcttgccagtttatgtagctccacttgaaattggagatgaagctcatttaactcaagatcagatggacaagattaaagaatgcggcgaagttggtaaaatgctttattcgatgttttctaatattcatgaacctgatggagatactcgaattaagatttatgatccgacagcggttggaattatgcttcatcctgaattctttactttaaagccagctaatgttgaaattgaattagctggacgctatacatatggtgctagtgtgatggatttcttaagtaaaaaacataatgcacagattgcaaccgacgttgatacagagaagtttgcagcttggttcattgatagtatcaagactgctaataatgggagaaaataatgactgatttagtctatcgctcagtaatgcgcgatattaaacaaaaaatacttaataatgaatatgaagatatgcgtttgcctgatgagcgaagcctaagtgactattatcatgtaagtcgttcatcgatgaagcgcgctttaggtttgcttgctcagcaagggatagtttttaaaaaaagaggtagcggaacatttattaatccgctctatttgaaaaatcaggcactttttaagtatgagggatcaaatttaggtattaccgattcctttagtgttcccggtaagaagcaaagtattgagctgttagactatcaagtaattaaggccgacgaagatttgagacaggacttgtttttaaaagagtcagattttgtttatcaaataaaacggcttcgtttgttagatgatcaaccatttttaattgaaacaggttttattcctattaagattactccagaattaaatccggatattcttaaaggatcgctctttaactacttagaagatacacaaaataaaactgtaacccgttcattcttaacaattacagttgagccatcaactttagaagatcagtctaaattgatgctggcacctaatgaacctgtaggtgtaatggaaggtattttctttttagatgatggaactccatttgaagtttcaaatatgagaattcattataaatatatgaagtacaatacttttgttaacttaagtcaagaataaaaataagccattgtttttctcggggggatgagagaaacaatggctttttgtatgggacgagtagcttaatcaaattgcaaactatcgtcaaccggggacagatatacatagtttaagttagtatttttacattgctcactgagggaattaattaaagtatcttgttccttagtaatcggaatttgcttaagtactatttgagattgcaaatacataactaacttattgctccaagcagctgcgtcatcgtggttttcagctttggctatgacttttaaaattgtctgctcaagcggaagatatgctttaatttgaactttattgaaactagtatataaatcttttaatactgtgataatttcatcgtgctttgtaatagatttttctaacatgataaagacctcactatcttaaataatttaactgatttctgggcccactaaaatactagcatctttcatgcttgaaaagcctattttgtatgaaagtagcggtttttgctaagtgtttatcttgatttaaataacattatactgatttaaatcagtgaatcatttcttaaatactgattaatccttaaaataaagctctaaatacagataaatacgtaaaatgaaagagctttctgataagattagacatatgaggtgagataaatgcaatcacaagttgaaagattagatttaattagacaaaaattagatgagaaaaaaacaattagtacacgtgaaattatgaaattgtgtcatgtctcttttgatacggctaggagggatgtaattaaattaaccagcaccggtcaagcgattcgaattcatggcggattgatgaaaattaaacaggggacagtgccagattataattctcgcgtccatgttttgtcgcctataaagaataaaatagctaagatgacagcaaaatatttaacagctgataagttgatatatttgaatgcttcgacgactatttcgcaattatgtcgctaccttaacgggttaaatgcaacagtgatgacaaattcgattgataatgcgggtgccttaatgatggataacttgcctaatgttatcttattaggcggctatttgaataaagagaaccactatacatcttctttaaatagtttaaaagaaatagatcaatatgaatttgatattgccgtaatcgggacatcatcggttaataaaaatggagtttttgtagttaatcactctgatgcacaaattgaaagagaagtagttaatcgaacaaaaacagttattttattggcagaagaatataaatttaaagaagatagatcttctccgtataaggtcatggattgcaaacaagctgatattttgattacagataataagcttgatccccagtatcgaaaatattttaaaaagaatattaagattcgggaagtacttgaggaggaaaatataaaaagtaagtaattataattggaccgtcccaatgtttttaaaagttgaatttttgcacttgatgctatatgatattactgtaataaggaaatgaaaactatttcaaggagatatagctatggcagtaaattacgattctcaagaatacttaaagagtgttgacgcatactggcgtgcagctaactacttatcagtgggacaattatttttaatgaataatcctttacttaaaagagaattaaaggcagaagatgtaaaacctaagccaattggtcactggggtacaattgtgccgcaaaactttatttatggacatttaaatcgtgcaattaagaaatatgatttaaacatgttctacattgaaggttctggtcacggtggtcaagtaatggtatcgaactcatatttagatggttcttatactgaacgctacccagaaattactcaagatgaaaagggaatggctaagttatttaagcaatttagttttccaggtggagttgcgtctcatgctgctccagaaactcctggatcaatccatgaaggtggagaattaggctactcactatctcatggtgttggtgcaattttagacaatccagatgtaattgctgcagttgaaattggtgacggtgaatcagagactggtccacttgctacttcttggttttcaagtaagttcattaatccaattaaagatggtgcagttattcctatcttgcaaatcaatggctttaagatttctaacccaactatcgtttctagaatgagtgacgaagacttaactaagtactttgaaggaatgggttggaagccatactttgtttctgcatataaagacggtgaatttaatgggtataaagaccacatggaagttcaccaagaaatggcaaagacaatggacgaagttgttgaagaaattaaagctattcaaaagcatgcgcgtgaaaacaatgatgattccttagtgaagtggccaatgattgtctttagagtacctaagggttggacgggtccaaaatttgatctagatggcaatccaattgaaaatagtttccgtgctcaccaaattccaattcctgttgctcaagatgacatgaatcataaagaaatgcttactgattggatggaaagttataagccagaagaattattcaatgaagatggctcaccaaaagatatcgttaaagaaaataccttatcaggcgaccaaagaatggctatgaatccagtaactaatggtgggattgatccaaaagtcttaaatatgcctgactatcgcgactttgcaattaaatttgataagcctggatctgttgaaaaacaagatatggccgaatgggcaaaatatttagacaagatgtctgaattgaacccaactaatttccgtggttttggtcctgatgaaactaaatctaatcgtttattccaacttttagataatcaaaaacgtcaatggatggaaagtattcatactccaaacgatgaaaacttggctcacgaaggtcgtgtaattgactcacaattgtcagaacaccaagatgaaggttggcttgaaggatatgtattaactggtcgtcacggattctttgctacttatgaagcatttggtcgtgtagttgattcaatgcttacgcaacatatgaaatggttgagaaaagctaaagagcaagcttggagacatgattatccagccttaaacttagttgatacttcaactgttttccagcaagatcacaatggttatactcaccaagatccaggtatgttaactcatttgtatgaaaagaatcgtccagatttaattcacgaatacttaccagcagatactaattcacttcttgctgtatctgataaggcatttagagatcgcgaatgcatcaatgttttagtaacttctaaacaacctcgtcctcagtggttctcaattgaagaagctaaaaaattggttgataagggtcttggttatgttgactgggcatcaactgataagggcgctaagccagatgttgtttttgcttcaactggtactgaaccaacaattgaatctttagctgccattgacttacttcataagaaattcccagacttaaagattcgctatattaatgtaattgatgttatgaagttaatgtccccagaaaagaatccaaatgcaatcagtaatgaagaattcaaccgtcttttccctaaaggtacaccagttatctttgcatggcatggatttaagccaatgatggaatcaatttggtttgatcgcggccgtggtaaagatgatgttcatattcatggctatgaagaaaatggtgacattactactccttttgatatgcgtgtcttaaaccacatggatcgctatgacttagcaaaagatgtagtagaaagtattcctgagctaaatgaaaagaatgcggatttcattgatgagatggatagcttgcttgctaaacaccatcaatatatccgtgataacggtaaagatatgcctgaagttactgaatggcaatggaatggtttaaaataaatatattatttttttaagatcggattaatttccgatcttttttaattgtagttattaaaaaatcattgtattgttagtgtgacatttattgttataatatattgaggaaagtaagtgtaattattaataaataaaagatattgtaggaagggatgatgagatggattttaaagatgttttagcaagtgaacatgcaacaagaaagtttactgatcaaagagtaagcgaaaaaactgtgattaaggtaatcgaagaggctcaaagaacgccatcattactaaattcacaaccatggcgaatttatgtggctgaaggtgaggttgcaaaagcaataagaaaagatcatgaagataaggtcttggctcatgaagaaccacatgaagattttgcttcattgctaaaagttgagtgggatacgtttccaagtaagaatatggcaacaatgagtgaaactttagattactttttacgtggtgaatctgatgctttcgatcaagctcaaataaaattgtttaacgctccggtgatagtatttttgactattcctaaaaaatctccagcttggtcaatttttgacttaggtgcgttttcgcaaaccttaatgttagctgctaataatcgtggtttaagtacaatgccagctcatgctttcgttaagtacccagatgtaataagaaaatatttggatattccagaagatgaatcaattggaattggtattggtttaggatatccgaacaagaaagcagcaatcaataattataagtctaaacgtgtatcgttagatgaagttttaaagattaaaaaagatatctaattaagaaactcttgaagaagttaaagtctagctaatttattagatgaattctttaagagttttttatttgtttatttaaaataaaattaaaatatggcataattataaaaaataaaggagaagaagaatgatgttattagtttctcctgagcaatgggctaattgggataaatggtttaattacacattgccaggctatattttaattttagggataatttttttatttgttggattgattccatttttatgcgtacataataaaattacttatactttatttggggtgacaaccgtatttttagtaacttttctggggatagcttattttaaaaataaggaatcaaaagaatatgtcaaagaaaatcactatttaacggcaatggttagagagtatgatgctcagattttttctaataaatattatgatccagaggaaatcgagatgtttaaatatgtagctgatattcagaccccgtctcatttgccttccgtttacaaaaagataccaatgaagcaagaagttacctatcttggtaaaaatgattattatgcctttattaaattaaatgatgtagtaatgaagttcagtctggcagattgtaaaaaaattccaggaagtaaagcttactttacaggctatcattttaagattagaaataagaagtttttgaagttaggatttattgatttaaaacataatttacgcgataaagtagaactaccagccgattcctataacaagcaagtttcaagtaatattgaagaaaattataatcatcccggattagttgcaaactggatccctgattcagcaaaataatgctaaaatagagatgtaattatttaatatataaaaaaggtgaagatcacttgtctacaagtactataactactaatttaattgttattttcataacgtttttaattgcaattttctttgttgttgctgaatttgctttagtgcagactagatcgagtcagctagaagatatgctggcaaacggtcaaggcaaccctaagaaactaaagcgtgctctacacatggttcataatttgaatgagtcattgtctaccactcaagtaggtactactttagttggtgttattttaggttggattggtcaaggaactattgaagaactattgactgatgtgtttaaaaatgacaccttggtttggagcaaagactagcggagtattaggagcaactttaggtgttgtattgctaacttatttagaagttgttgtaactgaaattgttcctaagaatattgctattgacatgcccgttaagtgtttaatggcagtcgttactcctttagctgctttccatacgattgtatatccatttgtatggttacttaaccatagtgctaatggattgcttcatttattagggatgcagtcagctgatgaagaaagtgaagtttattcacaatctgaaatcttacgtttatctcgtaatgctgtaactggcggctcacttgataaagacgatcttttgtacatggaacgtgcttttgaattaaatgataaagttgctaaagatatcatgacagaccgtactcaacttcaagttttaaatgcgactgatgatgtaaaaacagctttagaaaaatatattaaagatggctttagtcgtttcccagttgtgcgtgataatgataaagatgatgttgtaggatacgtttatgcttatgatatcgtaagtcaagatcaggaaaatcctaatgttccgattactagaattattagagcgattattactgtgcctgaatcaatgttaattcaagatattttgaaattaatgattaaaaagcacacaccaattgttttagtagttgatgagtatggtggaacaagtggaattgtaactgataaagatatttatgaagaactcttcggatcaattaaggatgaaatcgatgatgtttcagacgaatatattgtccgcgatgatcatggaaatatccatgtttcaggaaagactactttatatgattttgaacgctacttccatactaagctgaaagcattcgaagatagtgatattattaccatcggtggttatatgatggaacactatcctaatttaaaacgtggtgagtctgttgatttagaaggctttaagtttaagctagtaaacattgaacaaggattcatgcgttggttcatcgtttctaagatcgatcaagccagtgaaaatgatgattcagaaaatagcgatcaaaatgataaagaaaaagataaataatcggaaaaagcacctcaagataggtgcttttttgtctaattaaatgttataattctactattaacaacgcatttataaaaggatatagagggttaaaatgcaaaatagtgataatattgacaacattattgatcgtgttttatttagtcaagatgacatcgaagagatttgtcaaagactaggtaagcaattaactgaggattatgctggtaagtttccattagtcattggggtactaaagggtgctgtatactttatgactgatttaacacgccatatgaatgtaaaaatgcaaaatgactttatggatgtttcaagctacggtgatggctttgaatcaactggtaaagttagattagatattgacgttcaagcagatgttaagggtagagatgtattactggttgaagatattgttgatactggtcatactctaaaatttatgaaggatctattaattgaacgtggcgcaaagagtgtaaagtgttgcgcacttcttaataagacagaacgccgtgaagatgatgtagttgtagattactatggctcaaaagttgaaaatgaatttgtagttggctatggattagactacttaaatgcatatcgcaatctaccttatgttggtgttttaaaaccagaagttattcaagcaaacttaaaccgttaatcattcaaaatatctttatcataaaattaaaaagggttgagactttctccttagctagtggaagtttcaaccctttatctatgagctttattattggcgattattctgttttttcatatagtaataaataggaaggcccaatagcgttagaccgataccggttattgagagccaaaattcattaattacagtactgatcacaatgaataaaccaccaccaattgagatgatcgggacaatcggataccaaggaacaacataaggacgttctagtttaggttcgcggtagcgcaaaattaccactgcaattgaaattaaggtggtaaaggtccacatgacgaagacgagcatattagttaacaggtcaaaagttcctagtagaatcattattaaagataccacgagaataattagggcactaagagtaggtacacctgtattaacattagtgcgactaattttatcagaaaatggtaacatcttatttttggctaaagtataaggtattctcattcccgtaagcataaaaccattaattgcgccataaactgaaattaaaattccaatcgtaactaatttaccgcctaaactaccaaataattttaacgaagctaaataggcagtattttgattgccaacaatttctttaaaggggatggcagttaaaaatgcatagttgactaatacataaattaaagtaatagccgatagtccaataatgatagctcttgataggtttttctcaggcttttcaatctcaccagctaaattagttacgttaatccaaccatcataagcaaataaagctgcaagtaaaccgccacttaagcctgtccaaaaagatgtattatgcccagcgcttaaagggaataagttaatatcgactttgcttgaattaaaaagaccgaaaagcacaattaaagcaattggaatggccttaagaatagtcatgactgattgcattcgggttgaaaactttgtagaaataaagtttaagcccattaaaaagatggcgagcagtagaccaattaaagttgcgtatttagcaggtaagttaaataaaacaacaaattgttgcccgaatattacacttaaagctgcaatattggcagggaaatagactagcatttgagcccagccaaataaaaagccccaaacttttccataagtatactcgatgtacttgatagagccgccagtaactggaagagcagctgcaatttcagatacggtaaggccagaagcgatggaaacaataccggctaaaatccagacgaaaagagttaatgaggaagtgccggtttcatgactaatgcttcctattttgaaaaaaacgcccccaccgattacagttccaacgactgtagctagggcttgaccaaagctaatttgtcttttcaagattgtgctttcctttcgatatatctataacttttagtaatgatatcattttatactaaatcttaatgaaagtggtgtagaaagaagaagttcgttaaaatagctaatggagggactgaaatgcatcgttatcgacataaatatactttcccaagtattattattttactcattctagctttttcaggactagtatggggatactttaatatgaggcaaaatacaactgttcctcgtggctcaaatatgagtgtattaggcattgaactagaccaaacaaaagattacattgatttacataagctagaaaaaaatggtatttcttttgtatatttgaggtcaacacaaggaaaatcttattttgacgataattacttactttatcgcgatcaaattcaaggaactaacttaaactttggtacaattattgcttatagtgatgaaacgagtaatcaagaacaataccaatactttttgaataaagttggaactaacaccggaagtttgcctgttatgattgtgccagctgctagtcacttgactaaatcatattggaagcgaatgggaatttttgctcaaatgataaataatcttggaaaaagagtaatgatagctggtgactaccgttatcataattattttccagagggaacacggttcttatatacgggagcaagtttaaaagatagacgacactatgctttttggtgttacactcaaaatggaagagttaaaaatatagataatctcgaacggaatgtaactatgtttgcttatattggtactaatacgcagtacgagcaattatatggtcagcaaggaacacaatagaggaaataaaatgtattcaaacgcaattacacaagttttagaaaaagaacataagaataaaccaaccttaattcaagaaagaacatatgatgctattcgtaatggtgctagcatcgtaggattagctaagactggtaccggtaaaactttagcttatggtttgccagtaatggagcgaattgccgaaattggtggtagaggcattattttagaaccaaccactgaacttgcgatccaaaccagaaataatcttttaccttatgcaaaatcattaggcttaaaaaccattgcattagttggagcaggaaatagaaaaagacaattagaacgcttaaaaaaggaaaagccggaaataataattgctacaccaggaagattttttgactttttatcagagaatcgaatcaagtatcaagacattaatgctttggtgattgatgaagcggatgatattttagaattcacaaaattagatttactgagttcattaggacaaaatttatcttcaactgctcaaattttactttttggagcatcagagtcagaaataacaaaagatgccgaagatttgtttaatcatattttcttactgattgatgtgcgaccagagcaaaaatctgaagttaaacattactttttacaagtctcaaatgaatataaaatgcagtttttgcagcggttggcaaagttagataagtttaagggtattctcttttttgatagtacagaaagtgaaatgagatttgcgcgaatttttagtcatagtaagacaaaatttgctgttttaagtaatgaaactagtaagcaaaatagagaaaagattcttagtgattttagagcaggacgaattaagtttttatttgcgactgatttagcagctcgtgggttagacttacctgatgttagctatgttattaactttgaaattccgagtgaagtaaatacctacttgcatcggagcggtagaacgggccgaatgaataaatcaggaactgttgtcactcttggggacgatcatgactttagagacttgaaaaaattactggctgatacttaccaagttcaaagagcatattttgcaggctatagtttaacgactgaaaaaccaaaacgaaaaaaagaagagccagaaactcaagagaagaaagtaaaggaaattaagcctaagcataaaaagaagcgttggcgcaataagaaaaataaaggatatcatcctcgaaaggatagaagagaaaaataatgtcatctttagttaaatggctagaaacttatgttttgccacctgcatcgcgtttagctcaactacgctggctagttgcaatgcgagatacttttatttctttactgccaattacaatggccggttcaattgcaatgctatttaatagcataattagagcagctaaagtacaaatgcattgggatactttttattctttaatgcagcctgtagtagcgattgacaatatcatttgggaaggtacatttgccctttttgcggtttattttgcaatttcttggggttatcacctagctaagacttatgaagtgaaccgatttgcaggttctgtcgcttctttagttgcttttgcaatgagcattagtgattctgttaaattgcacattgatggggatgtagttgatattaaaaatgcttttgatatcaaacaattttctacaatggggctatttacagctattatctttggctgtattggaacagcattatttattaccttttataaggctagaattagactaaaagtagatagtagtatgccgcatgcagaatgggttgcatttagtactttgatcccgatcctgctttctatttttattgtaggttttgttaattatgcttttcaaaggcttacaggaacctattttggtaattggctgcttactactattcaaagacccttggttaatttaggacagggctttggagttgttttattagttacatttttggttcagatcttctggttctttggaattaacgggataagtgtgctaactccagtaatggattctttgtggctgacaccagaaaatattaatgttacagctgttagaaacagtgagcatgttccttatatttgggttcgcgactcttttaatgtttttgcatggtttggtggagcaggcggaactctggtattaattattgccattttaatgttttctaagcgtaaagattatcgaacaatagcaaagatggctgtagcaccaggaatttttaatattaatgaacctattattttcggtctgccagttgtttttaatcctgtctatttaattccgtttgttgtagctcctttagtaaatgtatcattagcttattgggctacacaggctggtttagttaatccggttcaaatttttgttccaactgtaatgccgccacttattggaccgttcttagcttgcaattatgattggcgtgctattgtactggctctcattaatatggtaattgcgcttcttatttggatgccgtttgtttttgcggcagataagattgctaagcaagataataatcaacggaatttctatttacctcaatattaaatttatgatagtgaaaagctagtttttatgttaaagtagaaactagtcctgaccccgtagttcatctggatagaacaatggtctcctaaaccgtagaggtgagttcgaatctcaccggggtcatacatgaaaaaagcatttcttcaattaatgagaagaaatgcttttttatggctcttttgcaaatcctgttgatggataattttaagaaggaattaagcagctaagaaatagctgtttgattccttttcttttataatattttcttcgagtctaattctaattaataaatgtttgaaatttctataaccataagcagtacgttcaatttgtttaatcttacggttaactccttcaagacaaccattagaataagttgaggtaataccgtttaggacaccagaataattacgtttaaaagttaatagagtttgatgcatttgtttaccaacattttgttttgaatgaagtagatggataactttcttttcatcgttatcctgaatagcagtcataaagtcctgcataacccaataagtattttctaaggtttggtcacaatctaaaccatctaagacaacatgttcctgtgttagacagtccttaaaatgccagtcgtaataaggagtagtcttattaagtttgtcatatttcatgagataaagcttccaaggggactttaaaagcttatattcacggcttcttttattaaattgcttcatgatttgaactctgaaaatattaaacgatctagtaagcatttgaaccatatgaaaacggtcaataactatctgagcatttggaaataattctctagcaactaaaggataataacaattaagatccatagttactgttttaaccattgcacgagctttaggagtgaacttgtaaaaatagcgtagaatatcaggtttgaaacgagttctaagaatttgaacaactttgtgagtatcaccatctagacaaataaagtgaagctttttgcctacgcccttaaattcatcaaaagctaagtgttcagggagatgatcaaaggcatcatagaacttagaagagcagacttctaatactctttgaaccgtgttgacagatacattatgttctctagcaatgctggtcattgaacgatcttcagtaagagcagaaagtatttttcgcttagaagtgttagagatatagcagcctttattaaccagattagattgagccatagatctttttaaacagtcattgcagagaacacgttgttttcttaatctgatagtaacgggcttactagcatcagcagtaatgaaacgaacgttagagacgtaatgaccgttatgcttaagattagtagaacgacaataaggacaagtaggctggatcagctcagctaaatatattttgtaaatcttaccgttaatattttcatttgaataatcagaaaaaataatgtttttatcttcaatatcaagagtaaatttaatataatcatttaaagaggacatagtttaaatctccatacacttaattgaattggtcgaagaaggattttaagtaagagaggactatggcctctttttttacgtaaaaaaatcctgtcgatagaatatcatagatattcatcaacaggaaaaattatacagccgaaaaaagccgtggagcaactccacggctttttgcgattttaacgatcacaagtgatagaaataatttttctacttttatcaactgttatatcataaattcgatcttcatgaattagacgcttaataacaaattctacttcatcttgtctaataggacgtttatgattttccataacgatttcaattttatcagctgtttcgctgtatactactgtggtattacctaaagagtaaacttttacgaattgactattagtagctgctaattgtctttggactaaatcacggtagctatttgtaacatcaattaaatgcatcatatttataacctcgatatataatgtgtctttaaaatcccaatttaagtataacctttttgcagaatttataaaaataaaaataagagtcacggaacctgtgactcttatttgctcctaaataattaattttcattaattactattttaccgtcaactacattagcctttaggtctttagcagctggattatcaagtttataatcggctaccttatcttcaatttcttcttggatcgtacgacgaagtggacgagcacccatagaaggatcataacctttttcgacaagaagttcttttgcttcaggtgtaacatcaatatgtaggccctgatcttttaccatatcattggtgtttgcaagcattaaatcaacaatcttgattaagtctttcttatcaagtgcattaaattcaactatatcatcaagtctatttaagaattcaggtttaaagtattgacctaagctattcttaaattgttcttgatgactgttttcagctgcaaaacctacgctagcttctttgattccttgaccagcattagaagtcataatgatgatggtatctttaaaggaaactgtgcgaccttgcgaatcagttaagcggccatcatcgagaatttgcaagaataggtggagtacatcaggatgagctttttcaatttcatcaaataaaattaagctatatggattatggcgtaccctttctgttaattgaccagcttcttcataacctacataacctggtgcagatccgattagcttagatacagagtattgttccatatattcgctcatatcaaatcgaatcattgcatcttctgtaccaaagatttgcttggctaattgtttagctaattctgttttacctacaccagtaggtcctacaaataagaatgagccgattggacgaccagatttgttaaatccaactcgatttcgtcttattgcccgagcaacagtttcaacggctttgttttgaccaattacattatctttaaggtcagtagctaaattctttaattgagtttcttcttgtttttgtaagtcaccgacaggaatattagttttttcctcaacgatcttattcatgatcttttcagtgattttaggtgtttgatcaggatctactttctgatcttttaatttttcatacttttcaatctgatcacgatagtaggcagctttttcgtaatcttcattttttaaagcatcttgctttaagctttcagcagcatctagtctttctttgattttttcactatcaacataaggaatagtgagattcatccttgaaccagcttcgtctaaaagatcaatagctttatcaggtaagaaacgatcttgaatgtagcgtgaagaaagatctactgcagcttgtatagattcatcagtatagtgaacatggtggtaatcttcgtaacgcttacgaatgccttgcaaaatcttaattgtttcttcagttgtaggctctttaacctccactggttggaatctacgagcaagggcagaatccttttcgatgtttcgatattccttaatagtagtagcaccaattaattggaaatctccacgagctaaggctggtttaataatgttaccagcatccataccaccttcagcgttgccagcaccaactaattcatgaatttcatcaataaataggatgatattatcgttttgttctaattctttgattagttgttgcattctttgttcaaattgaccgcgaattccagttccttgaaccattgataccatatttaaagaaatgattcttttatcttgaagcttagctggaactgaaccgtcgacaatttgttgtgctaagccttcaacaacagcagttttaccaacaccggcttctccgataagaacaggattatttttagtccgtctgtttaaaatttcaataacgcgagcaatttctttatcacgaccaataactggatcaatcttacctttttttgctaagtcggttaaatctgtaccatactggtcgagtagggatttttgaccaccattgtttccacctctgcggccaccacccatttgcatgcgtggattatgtccttgaggattattttgttcattgttgttattatttaaggcgttgaataaatcatcaaaatcgccaaaaaatgcattgttattattcatactattattttgtccttgttgatttttcaattcttgataacattgttgacataatgagatttcacgatcttgcccatttacatttgtataaagatgaatagaggcaggacgttcgtgacagttatcgcataacattaatattccgcctttcttataatattcaggctatattcctattttagcactcttgatatatgagtgctaacttgctaatatcatagtacggatacttactaattgcaagtggtaagcccagatttttatggaaaattgatataataggataaagaaaaaattttttataaagatgcggaaacttcaaggagataagtataagaaatggattataaagaaatattagataaaattataagtggtgaattaaaagagtatagagttagtcccaaagatgcttttcaatttcaattagctcttagaagctatggtaaaagacagagtataactgggattgcccaaagaggtggggatataatttataccttatctgataatgaaaattaagtactttataatgtaaacatttacatttgtgttgttttcatttaaaaaacatgataacctaataaacgagtgggtataaaactcccgattatttttgattttaaaggagataatttaaaatggaaaaacgcgaatttcatattattgctgaaactggtattcatgctcgtccagctactttgttggtacaagctgcttctaagtttaactcagatattaacttggaatacaatggtaaatcagtaaacttgaagtcaatcatgggtgttatgtctttaggtgttggccaaggtgcagatgtaactattactgctgatggtgacgatgctaaagaagcaattgaagctattgctgacactatgaaaaaggaaggtttagctgaataatgtcgaaaactttaaagggaattgcagccagtgatggtattgcagttgcaccagcctaccttttggtagaacctgacctttcgttttctaaaacctcagttagcgatgttgatgctgaagtagctcgctttaaaaaagttgttgaagaatcaactaaagaacttgaaaaagttcgtgataaagctaaggaaagtttaggaccagaagaagcacaagtttttgatgcccaccttctattcttaagcgacccagaatttactggggctattgaaacagaaatcaaagatcaaaaaattaatgctgaagctgcattagatgaaactgctcaaaaattcattactatttttgaaggtatgactgacaatgcatatatgcaagaacgtgcagctgacgtacgcgatgtttcaaagcgtcttatggcacatcttcttggtaagaaattgccagatcctgcagctattgaccatgaagttgtagtagtagcctacgatttaacaccaagtgatacagctcaacttaacaagaagtacgttaagggatttgtaactgatgttggtggtagaactgctcactcagcaatcatggctcgttcattggaaattccagctgttgttggtactgaaactattactaaagatgttaaagatggcgatatgcttattgccgatggtttagacggcgatgctatcattaatccaactgatgctcaaatcgaagaatacactaagaaaggtgaagccttcgctaagcaaaaggaagaatggaagaagctaaagaatgaaccatctgtaactgcaaatggtaagaaatttattatcgctgctaacatcggtactcctaatgatatgaagggtgtaaaagaaaacggtgctgaagcaattggtttgtacagaactgaattcttatacatggattcaaaagacttcccatccgaagaagctcaatttgatgcttacaagaaagttatcgaagacatggatggtaagcaaactatcattagaacttgtgatattggtggagacaagcacttagattactgggatcttccagaagaaatgaacccattcttaggtgttcgtgctatccgtctttcaatgcaatacaaggatatctttagaactcaattaagagccttacttcgtgcatctgcatatggtccattaggaattatgttcccaatgattggtactttagcagaattacgtgaagcaaaacaaatcttagctgaagaaaaagataaactcgctaaagaaggcgttaagatcggtgacgacttacaagttggtatgatgatcgaagttccagctgctgctgtcttagctgatcaatttgctaaagaagttgatttcttctcaattggaactaacgacttaatccaatatactatggctgctgatcgtggtaatgataacgtttcttatctttaccaaccatacaacccatctgttttacgtttgattaagcacactattgatggtgctcatgaaaatggtatttggtgtggtatgtgtggtgaagctgcaggtgatgacattatgttcccaatccttttgtcaatgggacttgatgaatactcaatgagtgcaacttcaattttacgtatcagaagtttgatgaagaagatcaatactgaagatattaaagaattagcaaataaagcttgttttgtttcagaaactgctgatgaaaacaagaaattagttgaagaaactatgaagaagcttaatattcttgattagaaaaaagagtactaaaatagtactctttttttgttagaacttcacacaaacttcaatatttgttgctaaagtatactatgtaagctaataaaagaaatttgattacaacttataaaagacaagtatttgtgatacaatatcttatgtaagtgaaacagtagttatttttctacacgcaaaggagtgtggagttaagtgttaaatttatatacatcaccaagttgtacttcatgtcgtaaagctaaagcatggttgaaggaacacgatatttcatttaaggaaagaaatattttcgccaatccactaaataaagaggaaatcatgcaagttttacgaatgactgaaaacggcacagaagaaattatttctactcgttctcgtactttccaaaacttaaagattaatttagatgattatcaactaattgatcttgttgaaaagaatcctagcctattaagacgtccaatcattatggatgatagacgtttacaggtaggctacaacgaagatgaaattaggagatttcttcctcgtaaagttcgtcgcttagaacttgaagagatccaagcaatgactgctgatttttaattaaaaattgtaaaaacgttagcttttttaagctagcgtttttatatgagtaggaaaataggttacaatgtattaaagatagagacttcgaggtgataataagtggaagtacacagaataagtgaaaataccattcgtgtaacaatggacgcagatgaacttaaagaacgcggaataacaatgctcgacttgttaggaaacaaaagtcaaattcaacatttcttctatcaaattttaagtgaagtcgacacagatcatacttttgctaaaggagatcccgttacttttcaggtgatgccaagtagttctggattagaattacttatttcaaaagtacctgatagtgatgatgatagtagtaacaatccgaatgatcaattaagagatcttttaaagggattaggggctggagatgatgatcaacgcaaaactgaaattaatgatgatcgtgaaaaattagtcagtgataatcgtcgcgtctttaagctggatagtattgatttagttgcagccttagccgatgctttaaaggttgaaggattagcctccagtttatatacctatcatcatgaatactatctagatttagcctatttagatgataattatgtagaattgaaacccgaagatacttgggtaattgctaatgaatatggaactggaatgactgaaaagcaattccaaagaataaagaaaaatgctaagtgcttaattggccaagatgcattagggaatataagagaatatttcgattaaaaaagggagatgaaaaaatcatctctctttttgcgtatataatattgggcgataaaatgtacgcagctattttaaataaaaaattagtcttagccatcaaggaagcagaacaagttaataaaggatttaagaagttaaatcaggattattatacttgtccgtcttgtagaaaacgaatgattttgattctatcagaagaaaagctaccattttttaagcatttctatcaagttaggggaacaggagagaaagaagaacattatcaatctaagcaacttttatgtactgcactaaaagcaaatggagttaatgcagaagttgaggtcccattgcttgatcaacaattgagagctgatgtattagtagaaaataaattagcttttgaagtgcagtgtgctccgttaagcgagacagaatttaagcatcgacatagtttatatgaaaaattatctataaaagatatttggattgtgggtcaaaggcattatttaaaaaataaacttaatcgttcaaaagaaatatttctaaggtatagcccaaaatggcaatggtattatttagaaattaatccatttagttgtgtaattacattaaaatataatattttaaaggctgcagttagttcagaaataagttatgatataaaacatttttctttagatgagaagggaattgcaaatttatttacttttgctccaactaatcgacgaaatataaagtattcttctattcaagatcaaaaaatatatttacagaaacaaattactcataaaagtaaactagggttagaaattgcttctttgttataccaattacatttttcagtagcagatatacctgagaaactatttttagaactgagggagccaaaggaaaagagtccaataataacttatctacaaaaaaagctagatgattcaaaaaatcatctagcctaattgaattataacaagcgtaaactattatcactactagtctgtttatccccaacgattgcagattcaatttcttcacgatttgcgcaaccttcgatcatcataccagaatctccttggtcatcatcatagttaaaaataatggttgtaggagtagtgacgacgtttaagtcatcagcgagttttaaatccttatccattgagagctttatgtagtttgattctcgattctttttgaagttttttattgaaacatctaaagaatttagaatctcatcaacgagctctggagaataagttctattcatatcattaatcgcatgctgcaaattaatgatatattgtctagcctttttattgccgacaattaattttagagtgtgataatctttagttgcgttgtaagcactttgactaaaagtgttgaaaacttcgacattatttaaagaaagatgtctagctttgatatcgttccgaattgtgttcatcgtagttatgggaataaagtggtaagaaatattttgattgtaaccactgactgcagcgattatttcctgctcattttgataacagttaaccccaattggattaacaaagaaaaatatttcaaacattttgttatttcctccatccaagttcatgaatactgtatcagaaaatgaatgaaatggaaaaaaatttgttttattttttatgttcccaagcacgctgtactttactttgattagtattttccttattaactgtaaaattaaattgtttttctaattcagaaagtacctttttgatgatatcaggatcatcattttcaatttctaattcaaagtcatagtatccatctggaaattctgttaaatctaaagtcaattcacagttttctggaccgttagctagtattcttcgagtttgactccaagaaattaatttcaaagagtgaattgcttcattggaataatgcttttggaggtaatcaccaacatctcccccaaataaaaagaagtcaccttcatatgaactttgagtcatttgttcagcttgtgctacagatagtaaatcattaatttcgatccgttcactgtatttcttttccttaggattagtttctttaactttaatagtttgctctgcatgatcaacaagaattctgattcttaagctagcatcactattttttaaatcaaagtctggtgtatcaaaataataattcttttgaataaaatcagattttgcggtaaaagctgcacgcattttctcataggtttctttatctagtagagtttttgattcgatttctaaatttttactcataattttatcctttcactagttaatgttatccctctatatggtagaataattttgtttgaaacggaaaggatttatacatgaaagattgggatttatttttatggccttatcaacaggctgtttctgaattaaaagttaaatttcgatcacttagacaaagttttttaaacaagggtgagcattcgccgattgaattcgtggtcggacgtgttaaaacagttgattcaattaaagaaaaaatgacacggcgtgttattgcccctgaggtcattgagaatgatatgcaagatattgctggtattagaattatgtgtcaatttgttgatgatatctatcgagtagttgatttaattcatgaacggcaagatatgcaagtagttgaggaaagagactatattcaaaatgctaaaccatcaggatatcgatcctatcatatggtaattgaatattcagtttttttacctgatggaccaaagaaaataattgctgaaattcaaattcgtaccttagcaatgaatttctgggcaacagtagaacacacactgaactataaatatcagggaaaatacccggaagatatttctaagcgacttaagacaacagctgaggctgcttataagttagatgaagaaatgtcatcaattaaagatgaagtgcaggaagcacagagaatttttactaaatctaaaggaaaagagcaataatgaaagtcgcactcgtttataatgataaagttgaaaccttagcagtagttaaagcattagaaaaattactaaatgctagaaaaattgaaattgatcctgaaaatcctgacgtggtaattactatcggaggagatggaacattaatttcgggatttcataaataccaaaatctagttgataaaattagattcattggtgttcatactggacacttaggtttttatactgactggcgtaattttgaaattaacaagatggtagataatttgactaagaagcaaccatcttcagcttcctatccactcttggaattgatcattactactggagcaggtgaaaagaaaaagttgcttgcattaaatgaggcaactattaaacgagtttctaagactttaaaggccgatgtttacatcagagaccagttttttgaaagttttaagggagatggcttatgtgtttctacccctacaggttctactgcctatagtaagtcattaggcggtgctgtcattcatccacgtttaaaagctttacaaatgactgaaatagcttcaattaataatcgtgtgtttagaacactctcatctccaattgtaattgcacccgatgaatggatcaccattaagccggaaacaggtagtgatgatcattatgtagttacatttgatggttatgaatttaatcacaagcatattaaaaaaattgagtaccgtatttctcaacatgttattcgcttcgataagtatcaacatactcatttttggaatcgtgtagaagatgcttttatcggccaacctaaagataaacaataatgcaatattttaaattaaaatttgaaaataaaacacctcagaaactggggcgttttttgttaaaaaatggtttttctaaacgcgctttgactaatagccagcatcatggtgggatggttctagtgaatcatcaccgccggtatactagctacttgctgcatgctggagatgaagtaatttttattttaggagaagaaaaagaaaataaatggttaaagccctcgtctaagaagctaaatatcgtttttgaacaaaaagattatttagttattaataaagatgccggaatcttgtcaattccatctcgctatgaagatagtgatgcagtagtaaatcgtttattgcactattttcaacaacaaaaacaaactgatcttaagccacatgtgatcacaagacttgatcgagatacatctggattagttttggtaggaaaaaacgcagttgcgcatgcacgttttagtaagatggaaaagaatgagtttattaagaaatatcatgcaattgtgcatggaaattttgaagaagcacaaagacaaggaactattgatgcaccaattggcaaaatagatgccggagttaagcgcggagtagtaaataacggacaaagatcagttacaaaatatcgggttttagatcaagttaaaggtgctagcttaatagaattacagcttttaactggacgaactcatcaaattagagtgcacatgcaatatttaggacatcccttgttcggtgatcctttgtatggaattaaagataattttaagcgacaagcgttaaattgtttttatcttgaatttgatgatcctttttcagaaaaaagacaaaaaattgaaatagcagatcctattgatatggaaatattatggaagaacttgataagtaatgaattataaatataacagctaaattgattgactagtgtaaccgctttacatagaattaaatataagaagtgttaatactattcaaatatagaaaagaggatcacttgtatgtactattcaaaaggaaactatgaagcttttgcggatactaaaaagccggctggtgtagacaagaaatctgcttacataatcggtagtggattagcgggcctttcagcagcattctttttggttcgagatgctaagatgtctggtgataaaattcatattttagaagaattggatgttgcgggcggctctctagatgggactaaccggcctaatgctggttttgtagttcgaggtggtagagaaatggaagaccactttgaatgtatgtgggacatgtatcgatcagttccatcattgcggataccaggagcttcttacttagatgaatattactggcttgataaagaggatcctaactcctcgaattgtcgattgattcataagcgtggtaatgaattgccaacagatggactatatcaattgggttcgcatgctagtgaaattgttaagttagttttaacaccagaatctgaacttcaaggaaaaacaattgaagaatggttttcacctgaattttttgaaactaatttttggacttattggtcaacgatgtttgcttttgaaaaatggcattctcttgcagagatgagacgttattgtatgcgtttcattcaccatattgatggtttacctgactttactgccttgaagtttaacaaatatgatcaatatgattctatggtgaagccactacttaaatatctaaaagaccatggcgttaaatttgaatatggtgttcaagtagaaaatgtattagttgaccatgaaggaaatgaaaaagttgctaaaaagattgtgatgaagaagaacggtaagcaagaagatattgatttaactgaagatgacattgtctttgtaactaatggatcaattactgaaagctctacttatgggaaccaaactacgcctgcgccaattactcatgctaagggtggatcttggaagttatggggaaacttagctaaacaagatccggcatttggtcatcctgaggtctttagtgaaaacttacctgaaaaatcatggtttgtttctgcaactacaacgttaaagaataaaaaagtagccccttactttgaaagattgactaaacgtagtttgtatgatggaaaagtaaatactggtggaattattacggttacagattcaaattggggtctaagttttactattcaccgtcaacctcattttccaactcaaaagccaaatgagattgtagtctggatctatgctttgtattcagatactgaggggaattatattaagaaaaaggtagtcgactgtactggacaagaaattgctgaagaaatgctttatcatttgggtgtgccagaaagtgaaattaaagaattatcttcagaagaaaatatgaacaccgttccggtatatatgccttatattactagttacttcatgcctcgtcatgatggtgaccggccagctgttgtaccagaaggatcaaaaaatttggcatttattggtaactttgctgaaagccctactagagatacagtgtttactacagaatattcagttagaacagctatggaatctgtttatacactacttaatgtagatcgaggagttccagaagtttggagttctgtttatgatatccgggaattacttcgtgctatgtattacatgtctgataaaaagaaattagcagaccaagaaatgccattaccagaaaagttagctgtaaaagctggtatgaaaaagattaagggaacatggattgaagaattgcttgaagaagcaaatctaatttaaagatgtaacaatttatttgaatgagaattaacaaaaaagattatggtttgttttaaaccataatcttttattttgtcttttgtgttgcttgcttgaacatagagactaagttttttctaagcaagggatcatgagcataaagataagttcctttgattccccgcttaaataaaacatttaaagaattaagaaccatttcttcttcaagagttttgatttcacgaggatcagataaatcttttctctttttaaacatttctacatcagttattttgtctaaattaacacggattttgtttgtgccggggatttggctgatgggcggaccgataataataccagcatagtttaaatcaaatccctgacaagtatatattgagcctacctcatcaattgtttttggtatttcagcccaaggagtggcagtgtagttatattggtcccatggcattttgaattttccttcttggatgtaatgtttgcctccatctaaggtcgaaggatagccggatgtagaaagaactcgacttaatcctacttcacagttgcgcttaacgatttcctttcgcattttctcggcattatcaaaaatacgaaagtcatagttgctattagcattagtagggataggatcgatgattttatgtttagtaaatgaattgaaccaactaagtaattcagaagaagcagtcatcctaaattgatgttttaaatgatatttttgatgaggatagggatcgataattttttctaggcgatctttagtccaaagagttttcatttttagtacttgatatggatcaaatactaaaatcactaccttgcttcttttaataatttcagttaactgattttcatgataaaaattattgtaatgatctggcttagaaagaagtaagtgcgcttcatcgattataacaatatcagcgtgttcatttttcttatctaattgattaataaaagtagttggtctttgaaaatttttctttaagaggttaggtaaagttccagcaatttgacgataaactttcaaaatctctggatgattaacaagaaaataattgttagtttgataaatactactagttttatcatgacgtaatttttgtatttggtaaaacagggaagaaagaacaacgctttttcctgtaccagcctcgccatagatggtgaaaacagcgggaaagttccgattaatgtgttgtttagtaaaagaaataatttgagtaattagattttgttgttctattgttaatttcgtgaaaggtgaaagtttatcagctgcattattttgcatattgtatatcctttttccaataaataaagaaaagccatgaatattcatggcttaatttatagaatgagtttaatcttcttcaaataatacgcgtgtagcttcaggaacagaaatgtctttttgaattggagttagattaccggtttcagagtttcgacggtaaagagttgcgttattagtattttgattagctacaactaggtacttttctgctttatcccagttaaaatcacgtgggaaggaaccaaagacagagattctttgggctaattctagttttccatcatctaaaactttaaagacagcaattgaatcatgaccacgattagaaatataaataaattttccatctttagaaattcgaattgcagcagctccattatgatcagtaaaatcatccgggatagtcttatatgttgctatatcctcaaattcccaagtgttttcatttaaacgggcaacattaacctgactagataattcaccaacaatgtacatggttttaccatctggtgaaaaggtaaggtgccgagtaccaaagcctttttccatttgatagcgtgctaggtgttttaatctgttatcgtctaacttataaaaatcaacagcgtcgattcctaaatcacatgaaactaaattaccagcaggagtttcatcgaagaaatgtgggtgagcctgatcttgttctactcttggtccatgaccctcatgtttgtcgttagtaatgaaggttaattttccatttttgtcgtaagaaaacacattaatagttgctaagtgataatttgcagtgaaaactaaatgcttttgtggatcaacactgatgtagcaaggagctgctcctttgtgaaaataggtatctaatttttcagcttcaccatttttaattctataggtagcaataccgctttggtcgcctttttggatgatagtaaacaataaatcaccaactaattggaaatacgttggtctttcaacttcaacagtatttttaatattagttagtttaatatcagttccatcattttcaacattaacagtataaataccttttgagtcatggctcgtatagccaccaaaccaaactttcataatttttatgttagcctcctgataaaaactttccataacatatttattttctaccttttagtaagaataggcaatcgcaattaagtgttattggataaataagttgatatggtaaaatttaataaagaggttgataaaaatgaaatggaattctacaattactgctattggttcggaagcattagatccagcagataacatcgtaattttgtttgataataaagctactgataagttgcgggatgttgctgtattacaagggttcgatccagcaacaccagtagaaaaatttgtctttaaaaaagacgattctatcacaattgatggtactacttatctagccttatatgttgggccaatggttcaaatgaatatgcaagctattggtcatgctactttagtatttactaatgaagttccgaaaaggccaatgactaatgctatctatttagaaaaagattctaaagaaaaaatgcctgaatttaaggtaggcgactggattacctatgaacatagataagagggaaagctatggatgtaaaaaaacatcatcagaagagtaatttttttgttaagtggtttttgaataaccgttttagcatagccttacttaatattttattgttcttcctgatcattttggtatttaaccaaatttcttttgtgttaaatcctttttggacattttttaatgcaatttttccaccaattttagttgcatcaatccaatactatttaatggatccagtagttgactggatggagaaaaaattaaaagttccccgaataattacgattattctactatttgttattgttgtaggcggattgatttggatcattaatactttgatccctattattcagcatcaaactgattctctagtaaagaattggccaacttattggaaagatgcacaaaaaggtttcgaaaagataattcgcgatccacgcttaaatggagttcgcggaggaattaatcaagctatttctgatgcacaaactaaaatgtttaaaacaggtcaagatagcttcaatttagctttgagtaatttgtcatctgctgttaacgtaattacaatgatttttatgaccttattaacagcaccatttgttttattctttatgttaaaagatggacatcgtttgaattcctatgtgactaagtttgctcctaaaaaactacaacctagtttttcaagtttacttagtgatattaatggagcagttgcctcctatattcgaggacaaattactgttgccttctgggttggagtaatgtttgcaataggttattcagtaattggattgaattatggaattacattggcagttttagctggaattttgaatatgattccatattttggtacatttattgcctttattcctgcaattattttaggattaatcagctctccgatgatgttgatcaaagttttaatagtttttgctatagagcaaacacttgaaggaagggttatttcaccattagtaatgggaaataagatgaacatgaatcctgttacaactattttgctattaattggtgcaagtgcagtagctggactatggggagttatttttgccatccctgtctatgctgtaatcaaaataattgtaaccagactattcaattattatcgtaagatttcaaatctttatgatgatgagtcaatcgaagatagtgatactcaaggaagtaaagagtagaattgaagatagaattaagcgtggtacttgccatattacaggtgctgcgtttttttacaagaggagttttttatgacaaatcacgttgtactttatgaaccattgatgccagcaaatacgggaaatattgctcgtacttgtgcaggtactaatacagtgttagatttaatcgaaccgcttggctttcaaattgataataaaaaaatgaagcgtgctggattagattattgggataaagttgatattagaatgcatgatgatttagaagcttttttaaatacacttggtccaaatgatgaaatgtacttaatctcaaagttttcttcaaaaaattatgctcaagtagactatacggatcccaataaagattattattttgtttttggtaaagaaacaacaggcttgccagaaacttttatgagagaatattatgataggaatcttagaattcctatgtctgataatattcgttgttataatttatcaaattcagttgctatggttctgctggaagctttaagacagcaaggttttccaaatatggaaaagagccatcactatgaaaatgataagttaaaggataattacaatcgtcctgaacgttatgaaagaaatttaggagagaattaaaatggattttaaaaatatgaccccaatcgtagttcgttcttttcactatgatttaaatgatgaacaaaaggtgaaaaatgaagttaatgtttccttgcgccaggtttatcaagatttagaagatggtagtcaagatgaaggtaagaatggcaaatatttcgaaattgccgttccttttgaagtatcacctgctccaggtgactttacagttagtggagtaattactagagtggttcaatttgttgactattttggggatggttcagatttggaaccgtcagagtatcaactactttctagacctttagttgaagaaattgaaactttgacttatgaaattactcaattaactttagatcacccagttaaccttagttttaagtcgaactttaacgagttaaacaaggataatcaaaaagataaagatgacaaataaaaagattgagaaggtgtcttgatggctaaaaaacgaaaacgcagggcaacaaaaaagaaaaaaacaactactaaaaagaaaaagcaaagtatggactgggttattactggaatagtacttgttttagtagcagttttaagttgcgttcatttcggtttatttagtcaacaactaattaatttaattcgattttttgttggtgatagtcactatttagctagtattgttcttggtttgtttggcctagtgatggttatttataatcaacccccgcattttagcttgaaacgtgggagcgggttaggtgtattttacttgggcttactcctgtgggaaagttctcgcgtttttaatcaaatgatgattcatcagggatttgtaaatgcttttttgacatcaattagtgaggaattttcccgggcgcagattacgactaaggttggtggcggctttattggaagcatgttttatcaacttgtttttccaattttgggaaccgtaggatctgaagtaatatctttgttgatgatgctaatcggtattttaatgatctgtaacgtgaaatttgctaccttgctgtccggttttcaaaaaggttcacaattagtaattgagaaaaataaagatgctggggaagctttaaaaagtaaatacagcgatttagttgaaaagcatgagcaaaataagcaagaaaaattaaataatcgagaaaaactaaccgatcctttagataatcatgatgatactttcccaagtatgtctgattttaatagtgaacctgcggcttctaataaagttaaggaagaaagcagtccaaaatttgagcctccaattgaagtttcccaagaaagcactccgatagcaacagaagttgaagatacttctacagatgatttgccagcttcacattcttatgctgaagaagatcaaaagatgaaacaagaacttcaaactgttgatcatggagatttagagacaaaacaaagtagtcagccaaagaatcccaactataaaaagccgccaattaatttattgtcacctataaaaaatgtagatcagagtcaagacaaggctttaattcaaaaaaatacagaagttttagagtcaacttttaagagctttggcgtgcatgttatcgtaaaaaaagctgtattaggtccaacggttactcgctatgaagtccagccagcagttggagtgaaagtaagtaaaatagtcaacttagcggatgatcttgctttggctttagctgcaaaagatatccgtattgaagctccaattccaggtaaaccattaattggtattgaagtgccgaatcgaactacttctgccgtttcatttaaagatgttatggttcatcaagatgcaaaatcaaaagaggtttcgcttgatgtgccgttaggcaaagatgttgaaggaaaagtaatttcagcagatttacgtaagatgccacacttgttaatcgcgggatctactggatccggtaagtctgttgcaattaacacaattattactagtgttttgatgaaggcttaccctgaggatgtaaagttagtactaattgatccaaaaatggttgaactttctgtatataatggaattccccatttactaatccctgttgttacagatgctaaattagcaacgaatgccttgcgtaaaactgttaaagaaatggaaagacgctaccagctttttgctgctggaggcgttcgaaatattactgagtacaatcaaaaagtagttgaaaataatgctgataaaaataattcagcaatggaaaagctaccttatattgtagtgattgttgatgagttaagtgatttaatgatggttgccgggcatgatgtggaagatgcaattgttcgtttggctcagatggcgcgagcagcaggaattcacatgattttagcgactcaaagacctagtgttgatgtcatcaccgggttaattaaggcaaatgttccttcaagaatctcttttgctgtttctagtggagtagattcgcgaactattttggatcaagttggtgcggaaaaacttctgggacgtggagacatgctcttcttgccaattggtgctgctaaacctgaacgagttcagggagcatatatctctgtaactgaggtagaaaaaatagtatcctgggtaaaggaacaacaagaggccgtatataacgaagatatgattccttcgaaaaatgattctgagggtcaagctgagaatgaagatgagcctgaagatgaattttatgatcaggcagtagccttagtgagaaagcaacaatcagctagtgtttctatgcttcaacgtagatttagaattggatataatcgagctgcaagaattgtagacgaaatggaagctaaaggaattgtcggaccatccgaaggatcaaaacctagacaagtacttattccaccagaaaaggacgatgaccagtaattatgacaaatattagaattgaccataatttaaaatttaaaacagccacgttgggctgttttttacgtttacctttagataaaaaaacactggcattagcaaatatcttagcttgcatgcagagcaatgccactaaagaatttccgggtataaacttacaggcaaaaactttttctaacctttataatacgagtttgcaagtttttcctgaagtatttggaaatcaaatcgtagttttttatactataaatttcgttgaaccacgtgaaatcttagatccggactataattataaagtaataatggatgccttctttaaggtggtaaaagagcctctttttgatggtcaattattagaattagcaaaaaggcaactcgaacaagaaagaaaacaatattatgagttgccggcgaatgtttctttaagcggattttttaatacctggtatcgaaatatgcctagttaccaagatagtgtttttggggatgaaaagacactcaaaaacgctagtttagaagaaattaagtcattttttaatacgttgaaaaatgctccagctttttgtttaggacaagcacaagatcccgatagcttaactgacttagttcaaacacaacttgattggcctggctattttgatgattttgtagtttctacattgtctcttcctgcagaagaaaatccaattgaaagagagatacaatttaagagtgaacaagcacagcttttaattgggtatgggtatgatcaatctcttccaatatatttaaaacaatttggtggattatttttaggagaatatcttgctggggatgagtcgtctaagctctttactgaagttagaaaaaaactaggagcagcatatgcaattgatgcgactaattatctcaataattctctatttttaattagtacaggaatttctaaagataaaatagcagctgcttctaaagcaattaaaatgggtgtaaaagcagtacaagatggaaaagtgaatgaaggaattttctctaaggctaaatctgccttaaagcgtaactaccaaattagtactgatcggcaagatttgattttgattcagatgctagccaatgctctaagagggcgtgactatacttttgtacagagaattgctgatgttgatcgctttaagatagataaattaattgaattcagccaaaaattatactttaacgaaagctattgtttaaaatgaaaaaattagatgtaacaactagagattacaagtctggatttcgtgcaaaagtaattaggagaccactttttgcacaaaagtttatgggaataatcgtagattttggtggcagtgatcctcaaaaattatgtggtggagcacattttttagagcataaattatttactaaaaaagatggtgacatttcgcaacgttttgaagaacttggagcttcgacgaatgcgtttactacctataatgaaacaatgttttatgcgagctttactgaacattggcgtcaggttttaccattaatttttgaattagtcggaacaacgcatttcaccaaaagcaatgttgctaaagaatcaaaaattattgctcaagaattagcgatgtatcaagacgaccccaattggcaagtaaattatgaattaatgcaaatgatgtttccgaaaacaagtttggcagaagatttaaccggtacaaaatctagtttgaaaaaaatgacgccagaaattttacaagaaatttatgacaataactatgttagttgccggatggaatttgttgcttgtggtggattcagcgaaaaccaaactaaagaaattttacgtgaggtagggaaacttgagagtaaatatttaatttctaaaaaagttgcacctaaaaaattatccattgtaaattctcaaaaagagcataataaaattattgcatccgatttaattacgtctagggtcggtataggaataaaactacctgactttaaaaaagtaggtttgaggaatagcacagcacaaagtatttttgaaatgatgcttcaagcaaagctaggagtaactagtccttggtttgaaaagatgcaaaaacaaggtattctaaattcaccaatggagctgcaggtctcatatactactgcgggtaattttgctacaattatcggcgcttctagtaagccagatttgtttttaaagaatattaagagccaacttttggaagttcctgttacggaagagtcctttgtatttcaaaaaaaggaagcattggcacagactattagagaatttgatgatcttagtacaattgctattgaagaagcagaatatggacttgaaaatgacaattttaattcggcagctcaagcaattcaatctttaagttttaatgaattttatacagctgttgaaaatatattggataaaagtgatatatttactacaactttaaaaggtaaagaggaagctaactaaatgaagcgtgcaataattttcggagcaactggtggaataggaagagctattgcagaaaatatggctgaaaatggctggtctttatatattcattacaatcataaccaacaagaagccggtaaaatggtacaggaattcattgaaaactatccagaccaagaatttttttcattaaaattaaattttttggctgaagatgatgtaattaaaaaaataatatcaaatctcttaccaataagtgctgtaatttttacacaaggaatcactaattatcaatttcttggaagtcaagaattagatgaaattgagaagattatccaaattaacttattagctccgataaagataacttcccttttagaatcccagcttttaaagcaggcacatggccgaataatatttattggatctgtgtatggaggacaagcaagtgcgctagagagtgtgtatagtgccagtaaaggtggattatcaagctttgtacaagggtatgcacgtgaggtagcatcggctaatttaactgtaaatgtgattgctcctggagcagttgatacaccaatgaatgcaatttttgatgctgaaactttaaatgaagttaaaaatgaaattcctgcaggaagattggcagatccgaaggatatatctttttgggtagaaaatttgcttgatgaacgttcagactatttaactggacaaactatttatgtcgatggtggctggcttgtttaatggtcgattagtttggtatactcatatttgaattattgcaaaaagttgagaggatattatggcagatattggagataaattacgcagtgctcgtaaggcaaagggcatgtcaattgaagatgtagaaaaaataactaagattcagcgtcgatatcttacagcaattgaaaatgatgattttgatcaattaccgggagatttttacgttagagcctttattaggcaatttgctgatgttgttggtcttaacggcaaggaattattagcagattataaatctgaagtacctgaagcaaaaccagaagaatatgttgaaaattcaatcgacaataagagcgaaagaattaaagagacaactaatagtcgtaagggactatggcgtaactatttacctcaaattgcaacagtagttggtgttgttctagtaattctagtagtttatattgtttacactcgcttctttactggaaccaatcaacagtcagcaaatcaagctgagaatgtaaccgtttcttctcatatcaaatcttcaaaatctaaagcttcatcaaagaagaaatcaactccaaaaactacaacctcagaagttaaaatttctagtttaggtaataatagttaccgtgttagtggattgaagagtgaccgaactttaactttaggaaccactaagaatgatgtttgggcacaaattttagtaaatggttcttctgtttggcaaggaactttgaaagctaatgagaagcactcagttcaattaccagaaaatgtaaacaatgtttctgtacaaatggggaatagtgtatcaactactttgactttagccggtaagaaggtaaatgcacataatgcaactaatccagcttcaccaatgacaattagatttacatttgctggacagagtaatcaaagtagccaaagtagtagtactcgtcaaagtagtgcaactactcaaagttcaactaataatgtaaataatcaaacacaacaaaaccaacaaaatcaaaatacacaaaatggccaaactactcaaaacaatacgcaaaatacgcagaacacacaaggtcaaactaatactacccaaaataatggaggtcaaagtaaccgttaatgaatttaccaaataaattaactatgtttagaattttcatgattccagtttttatgctagtcttaatctttaattggccagcaggtagtgcaactttcttaggagcacatatttattggtctcatgtgttagcagctgtaatttttgcagtggcatcaataactgattttttggatggacatattgctcgttcaagaaacttagttaccaacttcggaaaatttgctgatccattagcagataaaatgctaacgatgacagcttttgtatttttaatttcattaaatttagcgcctgcatgggtagtagctattattgtttgtcgtgaattagccgtcactggtttacgtttgattttggctgaaaataaaggccaagttttagcagcaaaaatgccaggtaaaattaaaactacgactcagatgctctcgattattttcttattgcttggtgatgtgtactatattggtacaatcttattgtacatttgcttaatctttactatttactctggttacgattactttaagcaaagcggcgacgtatttaaaggtgaaatttaagattaaaagaagcagagatgcttcttttttttgaaaaaaattaataaaaaatgcgtaataaaaaatagagaaatataatattgaacgctagttcgtatttttcttgcttttaggtagtcaaaccaagtataattattataaatggaataaggaggaagagatttggctaaagatgataaaaagaaggctttagacattgccttaaagaagattgaaaaagactttggaaaaggcgcagtgatgcgcatgggtgaaaaagtagacactcaaatttccactattccttccggttcactagctttagatgcagctcttggagttggtggctatcctcgtggacgaattattgaagtatatggaccagaaagttctggtaaaacaactgtggctcttcatgctgttgcagaagttcagaagcgtggaggaacggcagcttatatcgatgcggaaaatgcgatggatcctgcttatgccgaagcattaggtgttgatattgattccttaattttatctcaaccaaacactggtgaagaaggtctgcaaattgcagatacgcttattgcgagtggtgcaattgatatcttagttgtggattccgtggctgcgttagtaccaagagccgaaattgacggtgacatgggagattcacatgttggtttacaagccagattaatgagtcaggctttacgtaaactctcaggaaatatctctaaaactaaaactattgctgttttcattaaccaaattcgtgaaaaagttggggttatgtttggaaatccagaaactactcctggtggacgtgctttgaagttttactctacgattagattagaagtacgtagagcagaacaaattaaacaaggatcagacgtaattggtaaccgagttaaattaaaggttgtaaaaaataaagttgctcctccatttaaagtggcagaagtcgatatcatgtatgggaaaggaatttctcaaactggtgagttaattgatatggctgctgataaagatatcattaagaaagctggctcgtggtattcatatggggatgatcgcattggacaaggccgcgagaatgctaagcaatatctagaagagcatcctgatgtttacgaagaagtaaaagaaaaagttcgtgaagcttatggaattgatgctaaagcaattgaagaacgagaaaatcctgaaaaggtaaaacaggacaaggaagtaccagtaaacaaagatgcttccgatgaaaaaaaataatcgacagatacagttaaaccttggcttttagaggccaaggttttttgtatgattgacatcacttccggatacttttattattaataatgtgtgaaataattctataaaaaaggcgatagtaaaaatatggtaaatacaattttagttcctgttgctgtcgctattgtttctgtcttagttggaggttgtgctggctatagtatccgtaaaaataagtgggaaactcaagcacagaatgcagcccatgatgcaaaacacatcttggcagatgcagaaagtaaagctaaagctgtagaagctgatcttgcttcacaaaaagaagcaatgaagaaagctgcagcagatgcaaaaaaagaaaaaattctggaagcacaagaagaaattcatcattatcgcgaaagagtggataatgaacttaatgaacgacgtcaagaggtttctagacaagaaaatcgcttactgcaacgtgaagatgctattgatcataaagatagtttgttggatcaaaaagattcacaactcacacagaaagaaaaccaaattaaaaaattgcaggctcaggttctagaaaaagaaaatagagccgatcaattagtgaccgagcgagagaaaaagctctatgaagttgcagagttgaatcaagaagatgctaaaaagatcgttttagataaactttcagaccaattggttaaggaaagagcagaaatgattgaagaaagtaatcaacttgctaaggcaaaagcagatcattttgctcgtaaagtaattgttgatgcaattcaaagtagtgcagccgatacggtttctgaaaaaactgtttcagttgttaatttaccaagtgatgatatgaaaggtcgtatcattggccgtgagggtagaaatatccgttcatttgaggctttaactggtgtagatgtaatcattgatgatactccagatgtagtagtcttaagtggttttgacccaattagacgtgaaattgcaaaaagagctttagagcgtttaattaaagatggtcgaattcatccagcgcggatagaagaaatggttgatcgtgctcgtaaagaagtaaatgatgatatttacgaagctggtgaaagtgccttaatggaacttggtattcataagatgcatccagaattggtaaagattttaggacgcttaaagtatcggacgtcttatggacaaaatgttttatctcattctattgaggtcggtaaattaacaggtgtgatggctgctgaacttggtttagacgaaaaaatagcggtacgcgcaggattattacacgatattgggaagtcaattgatcatgaaattgagggttcccatgtagaaattggtgttgaacttgcacgaaagtatcatgaaccagatttggttgtgaatgcaattgctgctcaccatgatgatgttcctaagttatcctttattgcagagttagttgtagctgctgatacgatttcttcagctcgaccaggtgctagaagtgaatctctagaaaactatattcgtcgactagaacaactagaaacgattgcaaagggacacattggtgtaaaacaagcatatgcaattcaagcaggacgtgagataagggtaatggttgagccagataagatctcagatgctcgtactactattcttgctcatgatattagaaatcaaattgaacaagatatggaatatcctggtaacattaaggttacggttattcgagaaaaacgtgctgttgcaatagctaagtaaagacgaatctttaagattcgtcttttttgtttaccgctttattgtgtttatattggggtgtaggtataatgaaaaaaagaagtttaagaaagtagattgttatgtttcaaacaattgttaaaatattcttattagtaattattactgctgctataactccttttattagaaaattagcttttgtattaggtgcagttgataatccaaatgctcgtcgcatcaataaaaagccaatgcctactattggtggattagcaatatttgtagcttttaatattggagaatttgtcttattacggaaggattttccgactcatgaacttttttcagtattattggcatccagtgttattatcttaactggtttgattgatgatattttagaattaaagccgagacaaaaaatgtttgggatttttgttgcatccctggttgtatatttcttagctggaattaaagtaagagagttaagcttgccatttttaggccatattcaactaggttggtggagttttccccttactattttttggattcttgccttaacaaatgctgtcaatcttattgatggtttagatggtttagctaccggtgtcaccttaatttctcttgtaacaatgggaattgttggtttcttctttttaaagagttggcaacactatgttccaattatgtgtattatgttagcagcttgtttattgggctttttaccttataattttcatcctgcaaagatatttttgggagatacaggtgctttatatattggttttatgatttccgtcctatcgttaaaaggattaaagaatgtaacttttgtgtcattattagttccaattcttattttgggtgttccgattactgatacagtttatgcaatgattaggcgaaaattaaataaaaaaaatatatctcaagctgataaacatcacttgcatcatcaattaatgcgaatgggattatcccatcgtcaaactgtgttagctatttatggaatttcacttattttttcttttgtttcattgctttcattagtgtctcctcgctgggggatctggttattgattttaggtctgttattcgcagttgagctttttgttgaaacgatcggattattaggcgaaaaatataaaccacttctgcattttcttcaacacactattaataaaatggaacgtgcagatcctgaagtaaaagtgagacgattaaataaaaagaatacaaataaaaaagatttacgttaaaacaacgtaaatcttttttattgttcgtggaaatttaaattagtaacaggaatttcattaaatctttggtctattttcttgaaatctacttttcccgataataaattaattagatcctctttaacttgagtgatttgatctagatctaggaaaatttggattgttacatcagtagtatatatttgattatcaattaggattttattttcatttaaatagtgattaacctcatcaagtcgattataaggaattgtaaattcaattaattgctgcatgacgcattttacaacgccaatattttgagcggcttcagttacggaatttgaataagcgcggattaatccaccagcacccaacttaatgccaccaaaatatcttgtgactacagcagtcacatcttttaatttcattaattgcagagcttttagttcagggatacctgctgttccggaaggttcaccattatcactggccttaacttgattatcatttaatcctaaagtataagcatatgtattgtgagttgcatcatgatatttttttgaaacttgctcaataaatgtttgggcttcttccactgttttagtacgagctaacgagcagatgaatctactttttttgataactatctcatgttgacccgatttactgattgttaaatagtttagttgttttgatgacaaaaaaatcgcctccatttgcgtaattaatatagggtgatattgatgagtgaattaaaaggacgccaatgaatagataatcaaaataaccataacataaatagtaagacgacaaaagttcctgcaatgataaatggtttatgccaacgatgtaacactaaagcagatgcaagattacctaatggatatttatattgccgagaatgtattggggttggaagaataagtgaagagaagaatttagaaagaaacattgaaaaaagtacctatcctaaaatagttactccactaagttggcagggaaaattaactaatcaacaggagttgatctctaatgagttagttaattcctttaaagaacgacgaaatcatttaattcatgcagtaactggagccggtaagacagagatgctttttaaagtagtagaagaagttttaaaaaatggtttccgaatagcaattgctacgcctcgaattgacgtagttgatgaattatttccccgctttcaagcagcatttgaaaatgtggaaattggaaaataccatggacgtgaataccatgatgcaaaagatgagcaatttgtcatatgcacaacacatcaacttttaaaattttaccgggcttttgatttgattgtgattgatgaagtagactcttttcccttttatgaaaataaaatgcttcattttgcagctaaaaatgctgtaaaagaaaagggatgtacattttttctaactgcgactccagataaaaaattactaaaacaggccaaaggtaaggcaattaattattctttactaaaaagaagatttcataagggattactacctgtaccgaaagaaaaatatttctttaaaccttttatttctcgtaaaggaaaagttcatcctgctctgattaaacagattaggaaaattatagatatgaacaaacctcttctggtatttgttccgagaatcaaagatttgcccatatataagaaacatttgactgctgtttttaaagagaaaaggatcgtgagtgtatatgcgggtgacaaagaaagacaaagtaaagtcgctagatttcgtaatcaagaaattgatattttactaacaacaacaattttagaacgaggtgtaacttttaaacatgttcaagtaattgtaattgcggcagatgatccaatttacaatactccaagcctagttcagattgcaggtcgagtaggaagaagtgcagacgatagagatgggctagttttattttgttatcacaaatatacaaaaaatatccgacaagcgatgaaacagattaggatgatgaataagtgaataattgtttattgtgtcactcctcttttcgcagagagataaactatgaaaaattgtttttatttgttaagtataaggaaagatatacttgttctgaatgtctaaaaaagtttgttaaaaagaaaggaaaattatgttcaggttgtaataaagaaataaatacagaggggctatgtaatgattgtctacagtggaagcggaaatatgcaggcaatttgttagataatcgttctttatatcaatataatgatactttccatgatgttatggtgcagtacaaaagatatggagattatattttgtgtcatgtcctagctgaattaattgatcagttaccagcagctgactattatgttcccgttccgagctcgcccagtcatctagaaaaaagaggatttgatacaatttatgctatttatcaaaagttagttcctttaacgaaattattagttaagtcagatacggagaaagctcagggagaaaagaatagggaagaacggttattgactaagcaaaccttttcggctatcgataataaaaatattagtggaaaaattttattattagatgatatttatacaactggtcgaacgttatatcatgcacgagatgctcttttagaagtttatcctaattgtaaaataaatagttttacaattagcagataaatcattagtaaaaccgcttacaatttgctatactataagtgtaaagaaaaacgtcataagacgttggaaggagaatctacaatgttaaaatacaatgttcgtggagaaaatgtcgaagttactgatgccttaagagattatgttcaaaagagattgaataagctcgaaaagtacttcgaaatcaattctgatgtaattgctcatatcaatttaaaggtttatccagatcatactgctaaggtggaagtaacaattccacttccatacctagttttacgtgcagaagacacaactgatgatatgtacaagagtattgattttgtttctgaaaaactagaacgtcaaatcagaaaatacaagactcgtattaacagaaagagtcgtgagaagggcttaaaagatttcttctatgaagacttagaagaagaaaagaaagcacctaaagaatttgatattgttcgtaacaagcatttggatttaaagccaatgagtgcagaagaagccgttttacaaatggacttgttgggccatgatttctttgtttttgaagatgcagatacaaatggaacaagcattgtatatcgcagaaatgatggtcgttatggcttgattgaaactaacgaataattaaaacaatcttataaattaagagtctcttgagcagcgataagcttaagaggctttttcttgcaatagtaggtttctcatttttacaaattaatgttaaaattacatagtattattttagatttgtgcacaaaatttaaatttaaggaccgattaaatggctaatattcttaaaaaaatttacgataacgatagaagagaattaaagaaatttgaaaaattagcaactaaggtagaatctttaggagacgagtacgaaaaattatctgatgagcagctccaagcaaagacaccagaattccgtaagcgtttaaaaaatggtgaaacgttagacgatattctaccagaagcatttgctacagcacgtgaaggtgcaaaaagagttttaggattatatcctttccgtgttcaaattattggtggtattgcgcttcattacggtaatatcgccgaaatgatgactggagaaggtaagaccttaactgctactttgccagtttatttaaatgctctaacggggaaaggtgttcatgtggtaacagttaatgaatacctatctagccgtgacgaaagcgaaatggggcaattatataagtggctcggtttatctgtagggttaaaccttaattcaatgtctgcagatgaaaagagagatgcttataactgtgacgttacttattcaacaaactcagaattaggatttgattatttaagagacaatatggttgtctacaaagatcaaatggttcaacgtccacttaactatgcaattatcgatgaggttgactcaattttaattgatgaggctagaacaccgttaattatttctggacaagcagagcaagcaaacagtgaatatattcgtgctgatcgttttgttaaaactttagttgaagataaaagtgatgacgatgtagatgatgatgaagaccatggtgactacaagattgattggccaactaaaacaattaatttgaccaatcaaggaatcaaaaaagcttgtgaacactttggtttgaagaacctgtatgatattgataaccaagtcttagttcaccatattgatcaagctttaagagctaactacattatgttgaaagatatcgactatgtggttcaaaatggcgaagttatgattgttgattctttcactggacgtgtaatggaaggccgtcgttattctgatggacttcaccaggctattgaagcaaaagaaggggttaagattcaagaagagtctaaaactcaagcaaccattacttaccagaacttctttagaatgtataaaaagctggcaggtatgacaggtacagcgaagacggaagaagaagaatttcgtgaaatctataacatggaagtaatcactattccaactaaccgtccaattgctcgtaaagacttgcctgatattttatatccaaccttagattctaaatttgaagctgtagtaaaagaaattaaggagcgccacgccaaaggacaaccggtattggttggtactgttgctattgaaagttctgaacgtttaagccaaatgcttaaccaagcaggtattccacatgcagttttgaatgcgaaaaaccatgctaaagaagcagagatcattatgaatgccggtcaaagaggagcagttaccattgctactaacatggctggtcgtggtactgatattaaattaggacccggtgttaaagaattaggcggtttagctgttattggtactgaacgtcacgagtctcgtcgtattgataatcagcttcgtggtagatccggtcgtcaaggtgatcctggtgtaacaagattttatctttctctagaagatgatttgatgaagcgttttggtggagatcgagtaaaattattccttgatcgaatatctgataatgatgatgacaaagtcattgaatcacgtatgattactaaacaagttgaatcagctcaaaagcgtgttgaaggaaataactacgatactcgtaagcaaactttgcaatacgatgatgttatgcgtacgcaacgtgaaattatttacggggaaagaatgcaggttatttctgaagataaatcattgaaacctgttttaatgccaatgattaaacggactattgatcatcaaattgatatgtacacccaaggtgataaaaaagattggcgtaatgatcaaataagagacttcatttcctctgctattactgatgaagaaactactaaaaagcttaatatgaagcacttaagtgcggaagaacttaagaagagactttatcagattgcagaagacaattatgctgaaaaagaaaagcaacttgctgatcctgagcaaatgctagaatttgaaaaagttgttatcttgcgtgttgtagatgaacgttggactgatcatattgatgccatggatcaattacgacaatctattagtctaagaggatatggacaactaaatccgttagttgaatatcaagaatctggctatagaatgtttgaggaaatgatcagtaatatcgaatttgatgccacccgtctatttatgaaggctcaaataagacaaaacattagtcgataaaaacaaagggaggcagataatgtctctcttttttgctattattaaagtaaaaattaatattatgatgtgaggaaaataaaaatggagattagtgaaattcaagcagaattaaatgatcttagtcctaagttagagcatttcaggaggtctctttgacttcgattcattaaatgaaggtattgcgattaatgagcaaaaaatggcagaacctggtttttgggataatcaagaacaagcacaaagcttaattaatgatactaatcgaatgaaggaaaaaagtgaaaactttaagcaacttgaagcaaaattcgatgatgctcaaactgctttagaattacttaaagcagatccagatcctgaattgagtgaagaattatctgaagaaatggtgtcattatcacaaagttttcatgattatgaattatcattattattgtcagataaatatgatcaacataatgctctaatggaaattcatccaggtgctggtggtactgaagctatggattgggctgatatgcttttgaggatgtatcaacgctatgcagttagccatgatttaaaatttgaaattgaagattatgaacctggtgaagaagctggtgttaaaagtgtaagcatccggattcaaggaaaaaatgcttttggattacttaaatctgaaaatggtgttcatagattagtaagaatatctccttttgattctgctaaaagacgacatacatcttttgcttctgtagaggtaataccagagattgatcaaagcattgaggttgatattaatccagatgatttaagaattgacgtttatcgctcaagtggtgctgggggtcagcatattaataagacttctagtgcagttcgaattactcacttacctactggaattattacctcatcgcaggctcagaggtcgcaattacaaaatagagaaactgcgatgaatatgttacgggcaaagctattccagctagaagaagagaagaaaagaaagcagacagaagaacttaaaggtaatcaaaaagaaattggctttggttctcaaattcgctcttatgtttttcatccttacaatatggtaaaagatcatcgaactaattttgaaactagtgatgtaaatggtgtaatggatggaaaactagataattttatttatgcctacttacagtggctcttaagcaaaaaaaatccgaactaaagtttaaggaaaagatctatgggatttgtaactattttaatattggtattagctgcgttggtgattttaagtattttattttcaatatttaaattctttattggcttgttacctgttgctataattgttgccgtgattatttggctgctagctaagttttctggcaataaaaaagatacggatgaaactaatagccataatccattgcagccgtccactaataatcaaaagcgaaagaaagcacgagatgtttcagtcaaagatgtagaagataaagaggataacaaaaatggttgaagcagttaaagttagtgaattagtaaaagatctcccttcacttagagtggttgaaggaaaggaatatttagatcaaaaattaattaatacttctgatatttctcgtccaggtttggaattgacaggttattttgatttctatcctaaaaatagaatccaattgctaggaagaacggaaatttcttatagtgcacgtttagatcatgatttgcgtgagcgagtatttaacaaaatggcaactccagaaacgccttgcttcattgtgtcacgaggtttaccaattccttcagaaatgcttgaagcagctgagaaagaaaagatacctgttctttctagtaatatggctacaacacatttatcaagtgtcattactcaatttctagatgaaaagcttgcgcctcgaaagagtattcatggtgttttagtagaaatttacggaatgggtgtattgattattggaaattctggtgttggtaagtcagaaacagccctagacttggtaaaacgtggacaccgtttaattgctgatgatcgagttgatgtatatcaaaaagatgataagaccgtagtgggagaagctcctaagatcctaaagcatttaatggagattcgcggaattggaattattgatgtaatgaatctttttggtgctggagcggttaaggacagtactgaaattcaattgataatctgtttgcaaaattgggatccaaaagctaattatgatcgcttaggatttaatgaaaaaacgcgtgagatttttgaagtagatgtgccgcaagtaactgttccagttaaagtcggacggaatttagctattattattgaagtagccgctatgaacttcagagctaagaaaatgggttatgatgctagccaaaaatttgaacaaaatctaactgaactaatttcagataattctaaaaaagacgaaggtgacagcaggaaatgagtttagccttaaatccggtagcttttaatctaggtccgtttcaagttaagtggtacggtattttaatggctactggagttttagtagcaaccttaatggcaattaatgaaggaaagaaaaggcatattatgcctgatgacttcattgactttctcctatgggcagttccaattggttttattggggcccgaatatattatgtagtttttgaatggggctacttttctcaacatcccgatcaaataattgctatttggaacggtggtattgctatttacggtggtttgattgcgggactaattgtattattaattttttgtcatcaacgaatgctaccaccctttctaatgcttgatatcattgctccaggtgtaatggccgcccaagtaattgctcggtggggtaattttatgaatcaagaagcacatggtgctaaaacaaccttgtctttcttagaaagtctacatttgcctcattttattattcagcagatgtacattaacggttcatattatcaaccaacttatttatatgagtcgactttaaatttaattggtttgattttgattttgagtttacgtcatagaaaacatctttttaagcgtggagaaatatttttaagttatgtaatttggtattctgctgttcgcttctttgttgagggaatgagaacagatagtttatacattgctaatactattagagtttcacaagcattgagcttgattttattttttggtgcaattattctttggatttatcgtcgtaaggttgtaaaaccaaagtggtatttggctggcagcggtttaaaatacccgtataatagagattgaaagaaataattttttatagaaagtttgagtaaaaaaatggcaaagattgcagttttaggtaatggttcatggggttctgttcttggttcaatgttagctgataacggaaatgatgtagtattgtatggaaacattgacagtgttaaccaagaaattaatgaacatcatactaatactcactacatgaaaaattggaaacttaatcctaatgtacccgctactggagatttagaaaaagcattggatggtgctgaaattattttatttgttttaccaactaaagcagttcgtattgttgctaaaaatgcacgtaaaatattagataaaactggcgctactcctttattggtaactgcaactaaaggaattgaaccaggaagtaaaaaactaatttcagatattttaactgaggaagtttatccaaatgatagtgaaaaaatagtagctatttcaggccctagtcatgctgaaaatgttgctcaaaaggatttaactgcaattgcttgtgcatctactagtgaagaaaatgctaagagagtacaaaagatattttcaaataactatgtccgtttctacactaatgatgatttagtgggagttgaagtaggtggagcagtgaaaaatgttattgcaatcgctgcaggtatcctagttggtaaaggatatggtgatgatgcaaaagctgctttaatgactagaggcttagctgaaattactcgtttaggagttaaatacttcggcgcaaaaccaatgactttttcaggtctttcaggaattggtgatttaattgtaacagcaacttctcaaaattctcgtaattggcgtgcaggtaagcaaattggagaaggaaagagtcttgattatgttttagaccatatgggccaagttgttgaaggtgctacgactgttaaagctgtacatgaattagcagaagaaaagaatattgatatgccaattagtgaagctatttaccgtgttttatatgaaaatgccgatgtagatcaagaaattaagacaatgatgggaagaaatcctaagccagaaattcaactataagcaaaaagattgcaatttttatttgttcatagtaatatatacttacaaaaagtaagaatagaggcgagaatatggctgagaaaaaaaactacgatgtaattgtaattggagcaggacctggtggtttaactgctgctttatatgccgctcgagctaatttgaaagtagttattttggatcgtggtatttatggcggccaaatgaataatactgctggcattgataattatcctggctttgttgatattcaaggacctgaattaggcgaaaaaatgtatcaaacggctacaaatgctggagctgaatttgcttatggcgatgtacaaagtattatccaagatggcaataaaaagatcgttaaaactgattcaggtgaatacgaagctggtgcggtcgttattgctactggtgcagttcataagcatcttggagttcctggcgaagaagaatatgctggaaaaggcgtatcatattgtgctgtttgtgacgccgctttctttagagatgaagatgttgctgtaattggtggcggagattcagctattcaagaggggctatatttggcacagtctgctaagtcagtcactgttatccatcggcgtgatcaacttcgtgcgaaagctgaattacaaaagaaagctttcgaaaatgataagatgaagtttatctggaatgctcaaactgaagaaattgtcggagatggcaataaagtaactggtgtgaaatataaggataaagaaactggtgaagaaaaagaaattaaagtagctggtgtatttatttatgttggtattcaaccacaaacagatgcttttagagatttaggcattactgatgaccaaggttggatcctaacggatgatcatatgcgtactaaagttgatggggtctttgctttgggtgatgttcgagcaaaagaacttcgtcaaattgcaactgctgtcggtgaaggaagtattgctggtcaagaagtatataactattaccaaggtttgagcgaaaagtaaattatccaaattaaaagctgtctatcatgagttggtagacagcttttgttgtacgtgaaattaaaaatattattttgctttattctttacttatcttcatagccctttgggtgactcttgtgccagttccaagcagttgcgataacgtcatcaacattttcatgctttggcttccagcctagaactttacgtgccttacttgaatcggcaactaatgagtcaggatctccgcctcttcttggtccaatagtgtaagggatgtcaatgctagtaactttcttagcagcttcaagaatttctaagttagagtatccttgagcagtacctaagttaaagacatcagacttgttagtttccattacgtgcttaagagctaagatatgggcgtcaattaagtcttcaacttgaacgtagtcacggacattagtaccgtctttagtgtcatagtcgtcaccaaaaatagtaaagttgccatcaccagaaatagcactctttaagatatttggaattaggtgagtttcaggaccgtgatcttcaccaattgagccgtcgcttgaagcaccagcaacattaaagtagcgaagagcgatagacttaatgccgtcagccttgtcagcccagtgcataatcttttccatcatcatcttggtttcgccataaggattaattggatcaagtggtgtatcttcagtaatcggtaaagtctttggaataccataagtagcagcggatgaagaaaatactaggtatttaactttagcgtcatccatggcttgaagaagagaaatcatacctgagacattgttgtcgtaatatttcaaaggtttcttaactgattcaggaactaatgagtaagcggcaaagtgcataacagcatcaatgttttcgtcccgtaagatcttgcttactaaattagtatcttcgatgtcgccttgataaaatttagctctcttgtcaacagcctttctatggccagtgtagagagaatcaaggacaacaacatcgtttccctcttcaattaattttctaacagcatgagagccgatataaccggcaccaccaataactaatactttcatatttataatactccttctaaatttattatttttaacttaatttgaatgaaaattcaaaatttttacttgaatctattctatatttttcttcaacatctgtcccccaactgtctattccccctacaccgcgtacttttccagcaattactaaaactgttctgcgtgctagtggaagttcttcaatgtgtgtggcattttctaattcttcagcggtataggggaggcaactaaagttaagtggtttatcagttttattaatttctagttgaaaatcatttgtatcacgatctgcattattcaggctagtatttctagtgataattaatttatctgtgtccatatgcatgccattttcttgtggaaccaaatattttgtgacaggtaaaccttttacgtgaaatactcctttttttgcccctgctttacgatcaggatatgtttcagaagaaagtccataatattcaaatccagttgccatcgtaggcatgataaaacgcattcctaggactggaagagatggcaatccttcttttcccatgtaacgcattttaatagttgcgtgtccactggaatcaataacataggtaatcgtgcatatagttgccggcgtagtagtagttttataatcaaaactaatttttacgagatttgcatattcatggttagaaaattgattattgaatggagcgataggtagaggatcaaatttttgatcatcaactgttagatgaattttactacattggctgaacatatccgctcctaaccattgagcagccttaacgctaaagccattaccgcgatcgttatcggttgtggcacgccaaaatgttggagtagggatacgatagagccattctttattattgatttttagggattcaagtccgcctttttcataactaaaaatatattgaaattttttagtttgtactcctaacgctgcatctccgtaaataatgtggagtttatttgtgtaatccataataatatttaacctcctgcattgctggtttttcagttcgatcagcaaacattagaccatccccagaaaactcataatctgagtgtcgatcatcaaagtcaccaccgtatctgagtacttttttaccgcttattggatcataggttaaaagagcttgatcaataaagtcccaaataaatccgcctaaatattgtggatattcatcaattaatttaatgtaagatttcattccaccatctgaattgcccatatcatgcatatattcgcattcaagaaatggctttgaaggattattttttaaatatttttcagcttctttaggtgggagatacatgtaactttctaaatcagatattttattttttaagtctggtgtatgaaccacaccttcataatgcgtaaggcgtgtatcatcgtgcgatttatagaattgattcattgctattaaattttcaccagcatatgattcattacctagcgaccaaaagagaatagaagtatgattctttaaagtttcataattacttctggcacgatcaataactacattacgccattctgctaaagatcctggaacattatacgaaggctcaacttttcccattttttgccatgttccgtgagattctaaattattctctgccataacgtagataccattttgatcacataagtaataccacggaatttgattaggataatggcaagtacgtaccgcattgatattgtttcttttaaaggtctgaatatcggccttcatatcctgtttagtaatggtacgtccgctattcatattccattcgtgtcggttgaccccatttataattagtctctttccattgagtaatacaactttatcgtcagttattttaatttctcgaaatccaaatttataagaatctaactcaattagatttttatttgaatcgtggacttcaataaataactgatataaataagggtgatggttatcccaaagatgaatgtttttcagtaatttattttcgattgtaattgttgaagttagattatgttcttcatccagtaaagtttgcccattgatatcttttatttttaaacgtacatatccatcttttgtaccagtaaaggataatttggcattgaaaattccatcatggtagtcatttgtaattgttggttttaatgcaagatccattaaatgtgtttctggaaaagcaagtagctttactgagcggaaaattccagaaaatctaaacatatcctgatcctctaaaaaagaggcagtactgtgtttgaatacttgtacagctaaaatattgttcttttctttaaggtagggggtaagatcaaattcagatggagtaaaactatcttcaccatatccaataaaatgaccatttagccaaacaaacattgctcgttctactccttcaaagaaaacatgaacgtgctttccttgaaaagaattatctaaatcaaaatgtttaatgtaagaaccgaccgtattatcttctcctccactgaatgaacgatctgttttctgtcctagcgaataagctggtctgcgaaaaatttttccctcccaaggatagagggtatttatatattgattttgtgcataattatttaattcaatttcacttggaacaggaatgaaatcaaaatctgaagcatcaaaattagttttgtaaaaatcaagtggtctagtttggggattattagaaaatttaaattgccattttccatctagactttgaataaaactgctacgtttttgttcccattcttcataatttttgaaatataaatgatcactgtgcgctgcaatttgattaacgcggaaagtttctggatcatctagccatcgaatatttgctttcatggttctacctgatttctaagaatattatattgaagacgcttttattatatcacttaaataaataatttactcaaaaatagtaaattatttacaaatgatatttatgttttattgattagttttgaaaatgatcttctgaactgataatgttatttatagaaaaaatagaacttttgtttaaacagagtaattaaattatagaaagaattaattatgacaactataaaaaaaatagcagaagaatctggttattctccagctactgtatctcgtttgttaaataatgatcctaacttatccattacagctgatacaaaaaataaaattttagagattgctaataagttaggttactggaaagatcatcaagaaaagaaaattcgtcctacgattgcactgttgtatcgtgttaatcatgaagagcaattacaagatgaatattttacttcgttaaagaatgctttaatttcaacagttgaaaaagaagcccttcaaatgaaaaccttttatgaaatagatgatttaataaaaaatgcttctttatttcaaggatttattgggataggggctgcaccaattgaaaataaaaaattaaagcagttgcataagatattgcctaatggagtttttgttgatacaaatcctgctcctgaattatttgattctattcgcccaaatcttgaacttacggttaaaaatgcgatcgatctgttcttcaaaaaaggatatgaaaaaattggatttattggtggagtcggaccaaagcatgacggaattcaagaaattgatcggcgagctagtgcttttgctgagtacttgaaagctagaggaaaaaataataattatatgtttgttgaggggccttttagtgttgaaaatggttatcaattaggtaaaaaggttacggcaaaatgtaaaaataagtttccgcaagcatttttaattgcttctgatacgctagcagtgggcgttttacaagcatttaatgaagaagggattaatattccaaaagaaacagcgatattaagtattaacaatagcaatgttgttaaatatgtttctccgcctttgtcgtcttataatattgaccagcaagaaatgattgatatggcattaagtatgctgattaatttaattattaaacctgatcgagctcatattgatgtaaatatgaacacaaaattagttatccgtaaaagttttattcctaaggaagataaataatttaataaataaaaataattttttcatagaaaaataaaaaaggaatgctgatagagacattcttttttatttttatatttagtaaattatttagtaaatcaaagccatttctttacgaaaaatataaatgcgagtattatatcaatgtaagcgattgcgcggtttgcgatgaggaggaaatttttatgaaatctcatggaaagtcaggaaagcaaattctttcctacgcgtcattttgtttgggtaacttaggtcattcagctttctatggtgtaatgagcacatactttgttatttttatcaccagtagtatgtttagtggaatgcaggcatctattgcagataagctgattggattaattactggtttaatggttgtcatcaggatagctgaattagtaattgatcctattttaggaaatatagtcgataatactaaaacaaagtggggaaagtttaaaccttggattttagtgggtacactagtaagtgcactacttttattggtattgtttactggaatttttggtttggctcaaaaaagttggctcttatttgctgtattatttatcttaatttatatcggttttgatattttttattcattatctgatgtttcttattggggaatggtgccagctttaagtgaagattcacatgcacgtggaatttatacatcattgggtgctttttcaggaacaattggctggaacggattaacaattatcgtagtaccgattgtgaccagtgttacttatatggtaactggtaagcacgaagaaggagcagctggctggttagcttttgcagcagtaatttccgctctcgccattgtctgcgctttaattgtttgctttggtactaaggaaaagcacaatattattagaaattctgcgaagcagaagacaagtttgaagcaagtttttggagcaatatttcataatgatcaaatcttatggccaagtcttgcttacctcttatattcattagcttatattattactaatggtgttttgttttatatgtataaatttgtaattggtaagcctaacgaattctgggtagtaggtgttatcgcaactattattggcttttgtatcagtccaagttttcccattttaaataaatatattccaagaaaatggttatttgttgctggtcaaacttgtatggttttagcttacgttctcttcatttttggacgtaataatgtaatcctaatggatttgggattagttttactaaatatcaatttcgctcagttggtaactgtattgactttgactgatgctattgaatatggtcagcttaagaatgggcaaagaaatgaagcagttgtcttagctgttcgtccaatgattgataaatttactggggcagtttctaatgctttagttagttatgttgcaattgcggctggaatgactggaacagctactgctgctgatatgacggctcatgatattaatactttcaatattattgccttatatattccattaattttagctgttttgtcaatcattgtttttctgacaaaagtaacattatcagaaaagaaacatgcggccgttgttgaagaattaaaagataaattggcggagggcaagattgaaaatgataaagaagaacctgatgcgagtgttacaaatgaaattgtttatgcaccagcggatggtaaattaatgaatttaagcgaagttattgatgagaataataagccatttccaggtaaaggatttgctatcaagccaagtagaggaaggatctatgccccatttaatggaaaaattaaatttacctttgttactaaacatgctttcgaaattgtttctgatgaagggttacaagtagtggtacatgttggtttaggaacggttaacttacgtggaaaaggttttaagacttactatgatgatggccaaaatgtgagaaaaggagatttattacttgaatttgatcgagaccttgctcttgaaaatggttatcaagacacagtaattgttttttatacacaaccacgaaaaattgtaaaaaccagtgaagttgaaactggtaagactgttaagcatggagaagaagttgtaagcgtggaatttagagaagcactaaagaattcagaaaaaacaatgggattacaagcagaataaaggagaaaaatatgacacaattatcacgatttttatatggtggagattataatcctgagcaatggccagaagatacttgggcaaatgatatacaagtttttaaacaagcacatttaaactcagctactattaatgttttttcttgggctttactagagcaaagagaaggagaatatgatttttcaaaattagacaaaatagttaaagaattatctgatgctaattttgatatcgtccttgcaactgcaactgcagctatgcccgcttggatgtttaaaaaatatcctgatgtggcacgagtagattatcagggaagacgacatgtttttgggcaaagacataatttttgctctaatagtaaaaactatcaagttcttgctagtaaattagttaaaaaaatagtaagccgatattataaaaattctcatattaaagtttggcatgttaataatgagtatgggggcaattgctactgtgacaattgtcaaaatgcttttagagactggctaaaatataaatataaaaatttagaaactttaaataaagcatggaatatgaatgtgtggggtcataggatttatgattgggatgaaatagtagttccaaatgaattaggagatgcctggggagcagaaggcactgaaactattgtttctgcattatcgcttgattatttgcgttttcaatctgagagcttattgaaactttttaagatggagaaagctattataaagaaatatgatccagtggctttagtaacaactaattttcatgctttacctaataaattacttgactatcaaaaatgggcaaaagaacaagacattatttcttatgatagttatccaagttataacatgccaacttatcagtcagcatttttatatgatttgatgcgttcgttaaaacatcaaccctttatgctgatggaatcgacacctgctcaagtaaattggcaaccatatagtccattgaagagaccgggacaaatggcagctacagaattgcaagcagttgctcatggagcagatacagttcaatttttccaattaaaacaagccattggcggatcggaaaaattccatagtgcagtaatttcacattctcaaagaactgatactagagtatttaaggaagtaacagaactaggagaaaaactagaaaaaactggttcgacaattttaggatcaaagacaaaggcgaaggtaggaattgtttttgactggaataacttttggtcttatgaatatattgacggaattacgcaagatcttgattatgtagaatcaattttggattattataaacaattttataagcgcaatatcccaacggatatcattagcgttgacgacgattttagtcaatatgacttagttgtagctccagttttatatatgataaaaagcggtttagcagaaaaaattgatcaatatgtaaaaaagggtggtaattttgttgctagctatttatctggcatagtaaacgaaaatgatagcgtgtaccttgggggataccctggtcctttaaaagatgttttaggtatctgggttgaggaaagcgatgcagtaattccaggacaaaaaattactgtttccttagatagtaacaattatcaagctaacttaatttgtgatttgttgcatttagaaggtgcacatgctttaggaaactataatagtgaattttataaagaaacaccagcagttagtgagaaccaatggggtaaaggtactagctggtatattggaacgcaattagatgaagcgggattaagtaaaatatttgatcatcttatttcaattgtgaatataaaatctttaatagagactaaaacagatttagaaataactaaaagagttacaaaaagcggaaaagaattatacttcgtcttaaatatgagtaatgatacaaaagatttgccgtctgaatttgatgcatataagaatttatttacggataaaagtgcaaataaaaagatgaaggcatgggaagttcaattgttgagtaagctttagaaataagttaggtataaaggattaatattaactttataccctttttatgaaatttaataaatttatttactaaatagttttataattaattatgaaaacgattacaaaaaattaagaggtaaaaattatgaataaagatgaattacttaaagactatcaagaagtatttagtgaaagtggaaaagatgttttcttctcacctggtcgaattaatgtgattggagagcatactgactataatggaggacatgtttttccagcagcaattagtttaggtgtttacggcgtttatggaccaagagatgacaaaaaggttcgtctttattcaggtaatgtagatggtgaaattgtcgaatttgatttagatgatgatttagtagaaaaagataaacgcttttggactaattattttaaaggaatgattacttatttacgtcaacgagaagacggcgaaaaaattaaccatggttttaacctttatattaaggctgacttaccatcaggatctggtctatcttcaagtgcagcaattgaaatgctaatggggatgattttaaaagatgaatttgatttagatgttgatcgtccaactttggcaagactaggacaaaaaactgaaaatgaattcgttggcctaaattcaggaatcatggatcaatttgcttgcatcatgggtaaaaaagatagtgctattttccttgattgtaacacgatggaatatgaatataagccacttaaactgggcgattatgaaattattattatgtctactaataaagagcatactttagcagattctgcttataacgatcgtgttagtaaatgtcacaaggccttagaaaaactacaaactaagcttggtattaaagcactaggtgaactagacgataatacttttgatgaatattcatacctaattaacgatgaaacggaattaaaacgtgctcgtcatgcagttagtgaaaacggaagaacaatcagagcaactaaggccatggaagataacgatcttgaaaaattgggtcgattgattgatgcatctcatatctcccttcattatgactatgaagtaacgggtaaggaacttgatactttagcagaagcagcttggaaacaagacggagttttaggagccagaatgattggtggcggttttggcggtagcgcaattgcaattgtgaagaagaacgaagctgaaaactttaagaaaaatgttggcaagatttatcgagatgcaattggttatgacgcaagcttctatgatgcagaaattgtagatggaactaagagaatttaatattaagaggctacagaaatgaaaattattgagaaatttgcagatgaagttattgaaagtggagcctatcaagaattagatcgtgtatacataattaacaagatcaaagccttagttggtgatgaagaccaagaatgtgatgaaaaacaaacatcagtacaccaacttgtgcaaatggctgttgatcgtaaaattattccagatgacaatacttcacgcgaagtcttgaatgatgagttatatgatttgaagactccaacaccttcaaaagtaaatgaaattttctggcaaaagatgcaaaagtcagctattacagcaactgattggttttataagctttgtgttgataataattatgtcaaaaaagaagcaattgctaaaaatattgttttttcaggcaggagttctaagaatcatgaattagaaattactattaatctgtcaaagcctgaaaaagatcctaaagccattgctgccgcagctcacaatactggtaataaatatcctcaatgtgctctatgcttagaaaatgaaggttatgttggcggatatggaaaaaatgccagaagtaatttacgtgtaattcgaatgactatcggtggtcatccatggggctttcaatattcgccatatgcttactttaatgaacattgtattttcttagatcaaaagcatattccaatgattattaatcaacaaaccttaattaatttgattgatattgaaaaacagctcccagaatattttgttggttcaaatgcagatttgccaattgtcggcggttcaatgctggctcatgaacactatcaaggcggacgtcacgtctttccaatgatgaaggcaaagattaagaaagaagttatttttgataaatatccggatgttaaggtaggaatagttgattggccaatgagtgatttgcggctaattagtaaaaattcactagctttaattagtctaggtagtaagattattgatttttgggatcgttatagtgatcaagatcgtcaaattactgcttttgatggtaagactagacatcatacggttactccgattatgcatcgtgatggagaaaaatttgttctagatttagttcttcgcgataacaatactagcgataagtatccattaggaatttttcacccacattctgagctttggcatattaagaaagaaaacattggtttaatcgaagttatgggaagagcaattttgcctggaagacttaagaaagaattagaagaagtaaagaaatatttactcgatgaaaataatgagatagctgaaagccatcttgcttgggctcaagaaattaaagctaaccatcaaattactagcgaaaatgtagatagcatccttcaacaagctctagttgaagtgtttgatcaagttcttgagtgtgccggtgtcttcaagaataatgaaaatggagaagttggttggcaaaagtttaccgaggctttagttagcgaggtagatagagaaaatgaaaacaagttttagaaagtatagtcgtaaaaatggtcaggacttatgtgaaattagtcttgaaaataatcaaggaatgaaggttaagattcttaattatggagcaactttagaaaaagttctacttgatggcgaagatatgattttgtcattaaatagtccagaagattattcaaaagaaagaaattttctgggtggaaccgttggcagaatttgtggacgcgttcggctaggtcaatggaaacatggcaaccaaatatatcaacttcctcaaaatgatggagaaaaccacattcatggtggtattggaactgatatgaaaatctggaactttaaattaaaaaattcagaacaagagtctcgagttgatctctttctttttgatccagatggagataatggctatcccggcaacatgaagttacatgccacttataagcttgataatgaaaataacttgtcatacaaattagaagctgttagtgatcagttaacaatttttaatccggctaatcatacatatttcaacttaggtgaaagagctaccgacttaaaactccaacttgcagcggattactatttgccagtaggtacggatggattgccaaatcaaggaatgaaaaatgtagagaatacagtgtttgattttagacaaggtaagaagatatctgctgctttagatagtgatgatagtcaaattaacttgcgtaacggtctagatcatccttttattttgaatgggatgcagcctgcagcagtgttgtcatctaataaacacaaaatgattatgaccactaatgcaccagcaattgttacttatacagctaaccattttaatcatactggtgtagcaaacaatattggacagtacgatggaattactttagaagcacaatatccaccagcagaaggtatagagttaggagaaattactttactcccttttgaaaagtttgagcgtaagattaactggaactttagttaattacatacaaacagtagtaaattttataaaagcgtttaatatcttttgcaaacagaataatttaattgttaattatgatagcaatttcacaatgagttgcgttaaaatagcagatgaaaccataaaatttacgtaaagaggaaattatgaacgcaaaagaaatttatagtcaatggactaatgcaaataatttacctgattatttaaaagatcaattaaatgatctaggtaaagatgaaaagtggattgaagatgctttcggacaagatattaattttggtactgccgggatgagaggtagacttgaacctggtacaaacagaattaatttgtttactgtgggaagagtaaccgaaggtcttgcaagactaattgatgaaaatggtgaagaagctaagaaacgtggcgttgcaatttcttttgattcacgttatcactcaagagaattcgccgaacacgcagctcgtattttaggtgcacatggaattcatgtatacttatttgatgatttgagaccaactcctgaattatcatttgctgtccgtcacttaaatacctttgctggaattaacatcactgcttcacataatgctaaacaatataatggttataaggtttatggtgaagacggtgctcagatggcgccagaaaatgcagatcgcttgtttgcttatgctcaaaaagttgatgacatttttagcgttaaagctgctcccgtggaagaactacgggctaatggcacgctacagttgattggtgaagatgtagatgaagcatacttagctcgtttaaaggatgttactgttgatcctgaaatggttaaggctaatgctgataaattaaagattatctatactccattacatggtactggaaagatgctatatgatcgtgccttcagacaaggtggttttgataatgtgattccagttccaagtcaatctatcattgatccagaattccctacaactatcaagcctaacccagaataccgtgatgtatttgaaccaggatttaagcttgctaatgaagttgatgcaaatgttattattgcaacggacccagatgctgatagaatgggtgctgctgttagaaaatcagatggcgatttccaagttttaactggtaatcaaattgctacattaatggcctattacttattagttcatatgaaggaaaacggaactctttcatccgactatgaattagtaacttcagtagtttcaagtgcacttccatttaagattgctgatgattttggtattaaaactaagcatgtgctaactggattcaagtacattggtgaagaagttgaccggatgaataaagaagatgacggtaaattcctgatgggatttgaagaaagttacggttacttatttaaaccattcgctagagataaggatgctatgcaaggtgcattaatgtttgcagaagtagcaagttactatgcatctaaaggaatgactgtttttgatggattacaagagatctggcaaaaatatggtgtagcttacgaaattactaaggctatcgaaatgcctggtattggtggtcaaaagaagatggctgaattaatgagtaagttacgtaaagaacatttaactgaaattaatgatgcaaaggttgttaagattcaagactttgaaacccaagaaactattgaagatggaaagaaaactccattaactggtttccctaagtctaacgttttgaagtacttcttagatgatgaaacttgggttgctcttcgtccatcaggaactgaacctgtaatcaaggcttatgttggagtaaataagaaagatattgaaactgcagaaaaagctgcagaagagtatcaagatgcattagctaatatattaaagtaatgcaaaaacagtgcgaaaatacgttcgctgtagtaaaatgaatacgttatatagaagttgggctattttagtccaactttttttgcggaggatgaaaaatgattagacgacaaaaaaataaaaaatttgaacttgtctctaaatttcaaccagcaggagatcaagagcaagcaattaaaaagttgactgatggatttgagcaaggagaaaaagcacaaatcctagaaggtgctactggaaccggtaagacttttactatggcaaatgtaatagctaagctaaataagccaactttagtaatttctcataataaaactttggttggtcaactgtatggtgaatttaaagaatttttccctaagaatgccgttgattattttgtgtcttattacgattactatcaaccagaagcttatgtaccacaatctgatacttatattgagaaagattcatcaattaatgatgaaattgatcaattacggcataagaccactagtgatttaatgtcgagaaatgatgtaattgttgtggcgtcagtatcatgtatttatggtttaggtgatccgagagagtatgcggctagtgtagtctctttatctgaaggccaagagattagccgagatgtgctattacgagatttagtaaatattcaatatgatcgtaatgatattgattttcagcgtggacgctttagagtacgcggtgatgtagtagaaattttcccagcaggatattctgatcatgcatttagagttgaattttttggtgatgagattgaccgaattgttgaagtggattctttgaccggtgaagtaattggagagcgagaacaagtttctattttcccagcaactcactttgttactaatgaacaaattatggaaagagctttggcctcaattaaagatgaaatgaatattcaggtgaaaaagttcgaaggggaaggaaaacttttagaagctcaacgaattaaacaaagaaccacgtatgatatggaaatgatgagtgaagttggctacactaatggaattgaaaactattctagacacatggaaggacgaaaagctggccaaccaccacatactttgttagatttcttccccgatgacttcttaattttaattgatgaatcacatgccaccatgccagaattaaaggcaatgtataatggagatagggcacgtaagcaaaccttaattgactatggttttagacttccatctgcgttagataaccgacctttaaaattagaagaatttgaaaaacatgtaaatcagatcatgtacgtatcagcaactccaggtgattatgaacttaatcaaaccgatcacaaggttgagcaaattattcgtcctactggattacttgatcctgaaattgaggttagaccaattaagggacaaatcgatgatttagttggtgaagttaataagcgtattgaacgtaatgagcgtgtttttgttacaactttaactaagaaaatggccgaagacttaaccgactatttaaaggatttagggataaaagtgcgatatctacattctgatatcaaaactttagagcgtcttgaaattattagagacttaagactaggaaaatttgatgtactgatagggattaatcttttgagagaaggtattgatgtacctgaagtctctctagttgcaattctggatgctgataaagaaggttttctccgttctaccagacctttagttcaaacaattggtcgggctgctagaaattcaaatggtaaggtaattatgtatgctgattcgattactgattcaatgcgtgaagcaattgatgctacggagagaagacgtagtctacaaatgaagttcaacaaagagcatggcattactcctaaaactatcgttaaaccaattagagatgtaatttctatcactaaagatagtgaggataaagagaataaggaaagttttgctgacttaaactttgatgaattgactaagaaacaaaaacaaaatatgattaagactctaactgcacaaatgcaggaagctgctaagaaactggactttgaagaagcagctaacttgcgtgatgcaattatggacttaaaaaaacaggtgcatgaaaagaaaaagtagaggaggatagttaaatggcaaatgataagattgttattcacggagcacgggaacataatttaaaagatataagtttatcaattccaaaagataaattagtggttattactggtttatcaggttctggaaaaagttcactggcatttgataccttatacgctgaaggtagaagacgatatgtagaatcgttatcaagctatgctagacaatttttaggacaaatggataaagctgatgttgactcaattgatggattaaatcccgcaatctcaattgatcaaaagacaacatcacataatccgcgctcaacagttggaactgtaacagaaattaacgattatttacgtttattatgggctcgtgtaggtcatccaatttgtccaaatgatggaactttaattgaaagacaaagtgtagatcaaatggtagatcgagtaatggatttgcctgaaagaagtagaattcaaattttagctccagttatccgttctaaaagaggagaacataaagaggtatttaagcgaattcagcgtgcggggtatgtacgggtaattgtagatggcgaaatgcatgaaattactgatgagtttgagctagataaaaacaagcgacacagtattgatattgttgtggatcgtctaattgttaaagaaaatattcgtagtcggttatttgattcggtagaagcagcccttcgtttagccgatggttacatgtatgttgatgtgattaagggagaacgcattaacttttcagaatactatgcttgtccgatttgtggttttactgttggtgaaatggaaccgcgtttattttcattcaatgcgccttttggagcttgtcctgattgtgatggactaggtatgaagctttcagtagatgaagatttagtaattcctgataaggataagtcattaggtgaaggagctttagttccttgggctaactctaagtactatacagcgatgttagaacaagcctgtacagccttgaaaatccccttagataaaccatataaaaaattaactaaaagacaaaaggatttaattttaaatggatctaagggaaagaaaataaaattccatctcgaaggagactttggtgtaaacgatacagttcaagaatttgaaggaattttaaataatatcaatcgtcgataccaccatccaatgtctaaattcatgcgtgatgcaatgggtaagtatatgactgaactgacttgttcaacttgtcatggtaaaagattgaatgaaaaggctttagccgtgaaagtaaatggtaaagatattgctgaagcatctgatctttcgattgcaaaagcattagaatttttcaattcagttaaattaagtgaacaagaagaaatgattgctaagccaattttgaaagaagtacgggatcgtttgacatttttaattaatgttggattagactatcttactttatctcgttctgctggcactctatctggtggagaagcgcaaagaattagactagcaactcaaattggttctaacttgtcaggcgttatgtatattctagatgaaccatcaattggtcttcatcagcgtgacaatgatcgtcttatttcttcccttaagaaaatgagagatcttggaaattctctaattgtagtagaacatgatgatgaaaccatgaagcaagccgattacttagttgatatgggaccgggagccggagtatacggcggaaaagtgatggctgcaggtacgcctgaagaagtaatgaagaatccccattctttaactggggagtacttatcaggtaaaaagattgttccagttccattagagcgaagaaaaggtaacggtaagaaaataactattactggtgcaaaagaaaataatttaaaaaatatctctgtcgattttcctttaggtaaattagttgttgtaaccggagtatcaggttccggaaaatcaacattagttaacttaattttgaaacgtgctctggcacagaagttaaataataactctgcaaagcccggtaagtatgaatcaattaagggatataaaaatatcgaaaaaattatagatattgatcaaagtcctattggacgaactccgcgtagtaatccagccacatatactagtgtatttgatgatattcgtactttatttgcccagactaatgaagcaaaaatgcgtggctatactaaggctaggttttcttttaacgttaagggcgggcgctgtgaagcatgtcatggagatggaattattaagatagaaatgaattttttgcctgatgtgtatgtcccttgcgaagtttgtcacggaacaagatataactcagaaaccttagaagtaacctaccgtgaaaaaaatatttctcaagttttaaacatgacaattaacgaagcatgcaaattctttgaaaatattcctaaaattcatcgtaagttacaaacaattgttgatgtaggattaggatatgtaaagttaggacaatcagcaactactttgtctggtggggaagcacaaagaatgaagttggcttctgaattacaaaaactttctactgggaataacttctatatcttggatgaacctacaacagggttgcacactgatgacattaaacgtctgttagaggtattgcagcgcttagttgatgaaggaaatacagttttaattattgaacataacttagacgtcattaaaaatgcagattggctaatagatttggggcccgaaggaggagatggcggtggacaagttgtggctactggtactccagaagaagttgctcaagtaaaagaaagttatactggccaatatttaaaacctgtccttgaaagagatactgagttaactaagcaaatgataaataataaaaaggagcaaggggaaagttaatggtgttttagaaaattaagtgtagaatattatctgggaggatataaaaatgaacgacatttataattctagacatcaaggctttgattggggctcatttatagcaggaattttgtttgttatagcatcgttcttgttattacgctaccctggtcgtggtttacaagcatttgtatttgtatttggtattttatcaatcttacaaggtctaatttggatttcagcatatgttaaatttcataatatttttgatttgagctgggtaacaataatttctgcaattattgatattgtaattggtgttttgttcctatgttcacgtgaaattgggggattaactttagctattttatttgctatctggttcttagctgattcgattattgggatcattttctcatggcacttacgtgaatattcaactggatactttgttctttgcttaattttaaacatcattagtttaattattgcttttgctttactatttaacccaatgttagctgctattactttagtttacttagtagcattttggttaatggtatttggaattaatgaaatttttgtttcatggatgcatagataaaataaaaagtcgtatatcgttggaagactaccaaagataacgactttttattttatttaaaaaatggaacacccggtatgttataatgtcgattaaggagggataactatggctgaacaaaagaaacaattattgattgttactggtatgagtggtgcaggtaaaactgtggccattaaagcattagaagatatgggatatttcgtggtagataatttaccaccggaattattgggaagtttctgggaattaattaataattcttcggattttagtaaggcagcagtagttgttgacttgagagtaaagagtttttataaagatttggttgatgaaatcaagtctttagaggatagtcaaaatgttcagtcaacagttttgtttttagatgcttcagatgacgtcttagtgtctcggtataaagaaacaagacgcttgcctcctttagctcatacgggtcgcttgcttgatggaattcaagaagaaagaaatattttatcaagaaccaagaatatttcaaacataattattgatacctcccatttatctaccaaggaattaaagacaaaattagtagataagtttggagataatcgaactcggacgttttcaattgaagtaatgagttttggatttaaatatggtattccaattgatgcagatattgtaatggatgtaagatttttgccaaatccattctacattccccaacttaagccatttactggtttagatcgtcgagtttttgattatgtaatgagcaagaaagaaactaaagagttttatgctaagtttttagatatgttggagacggctattccaggatatattgctgaaggaaaagaaaaattaactattgcaattgggtgtacaggtggtcagcacagaagcgtttcaattgcacgccaattagcagttgatttagctaaaaaatatcctgttgatatttctcaccgagagattagtcgttatattggacaataaaggagcggagatggcgtacggagaaaataaaattgtacgtgtcattcgtggacgtcgccctaaaattgttgttattggcggagggacaggtttacctgttattttaaatgctctaaaggagcaaaacgctgatataacagctattgttactgtggctgatgatggcggatcgtccggtgcaattagagattatattaatgtagtgccaccaggggatataagaaatgtattggtttctttatctgatttaccacaagaagaaaaagatatttttcaatatcgatttaattcatctgactcattttttgcaggtcatgcaattggaaatctaattattgctgccttagatgaaatgcagggaaatatttttgacgctgttcaatccctatctagaatgatgcgaattgatggaagaatctttcctgcttcgaatgagcctttgactttaaatgcggaatttgtcgatggaacaactgaatcaggagaaacagaaatcacatcaaaagacaagaggattaaacgtgtctgggttaccgatactgactcagatgaagaacctaaagctgtgttgccagttttagcagctattatgcaagcagacgcagtagttttaggaccgggtagtttatttacatcgattttacctaatttgatgatttctaatttaggggatgctgtaagacaaactaaagctgaagtaatttatatttgtaatattatgacccagcaaggtgaaacagatcattttacagcggctgagcatgtgcaagttattaatgaccacttaggaggccattatattaataccgctttggttaacggtgctaagattgatatgactaaatttaacccagccgattatgatgcttatcttgaaccagtacggaatgattttgccggattgagggctcaagattgtcgagtaattacagctgactttatcgatcaacatagtggattggtttttcatgatggaaaaaaagtagctgatgaaattttgaatttagcttttgaagcatattgtcgaagacagaaggaacaggactagttaatggtttcatacgcaagtgatgtaaaaaaagaacttacaagtctgccagttcatcccgaacacgctaaggcagaattagcagcttttttgcgaatgaacggagtacttagcctgcacgatcatcaatttagtttggatattacaactgaaaatccagcgattgcaaggagaatattttctcttattaagactgcttatggaattgaacctctattaattgtttctaagaagatgaaattaaagaaaaattatcagtatttagttagacttcaaaaacaagttcatgaaattctaaccgacttagaaatttttgatagtaataatggtcttattacgggaattcctgaaaagattatgtcttcggaacaaagagcaatgtcctatttaagaggagcttttttagcatctggaagtgtaaataatccagaaactagtcgctatcatttagagatttattctctttatgaagatcacaatcaagatctattaaagttaatgaacaatttcttttatttaaatgcaaaagaaactaggagacgaagtggctatatcgtctatttaaaagaagcagaaaaaattggtgattttctccatatagttggtgcagtgaacgcaatgctagcttttgaagatttaagaattatgcgtgatatgcgtaattcggtgaatcgtttagtgaattgcgatacagcaaatctaaaaaagactgcaaatgcagcagctaagcaagttgaagatattcaattgattgaagaaaaatttggtttagaaaacttacctgaaaaattgactgtgctagctcgttttaggttaacgcatccagaactttctcttaaggaagttgcagcacaagtaccagatggtccaatctcaaagtcaggggttaaccatcgttttcaaaaaattcgtgaaatagcgaagcaattaaaagaagaaaattagataaaaaaatagagctcacatcgtgagctctatttttgtctgaataaataaactagtctttcttttggtttaccaaaatttcatcgattaaaccatagtctttagcttcttcagcagacaagtaattgtcgcgttcagtatccttaaggatcttatcaagaggttgaccagtggtttcatgtaaaatttggttaagttttttacgactctttaaaatttcattagctgcaatttgaatgtcagtttgttgaccttgtgcaccacctaacggttggtgaataagaactgttgagtttggtaatgcaaaacgtttacccttagttccactagttaaaaggatggaagccatagaagcagccataccaatggcaattgtagatacgtctgatttgataaagttcattgtatccataattgctaatccagaggtaataacaccacctggagaattaatgtaaagagaaatatctttagtgttatcttgtgcatctaagaataaaagttgagcaatgatggaattagccatttggtcattaatttcaccactaagcataatgattctatcttttaataatcttgaataaatgtcgtaagcacgttcaccacgtgcagtttgttcaataactgtaggtacgagcattaattttacctcctaaacaaaattagcactctaataagtacagtgctaattaaatcacttgcttttaatcatgtcaactgatcgagcttaattttatgtagaaaaaatgaccgatatattttttatatcggccatttgtaattaatccattagtggattattaccatcttcttttttcttgattgctggtaaaatcaatcctaaagcgatcaagataattggagtaataatattaaggaaaagtgtaaatggatcaggagagtaaagtcctaaaatacaacatgcagctgttacaatgaaacaccaaattccggcagtatacgcaagaccttgattttttgtcatttgataagaagtatcaaattttgtttgatgttttctaagagcaatataagctgcaaatacccataaatagcgcattggcattgtagtagaatttaacttaactaattgtgccataacagcttgtgcatctggtagtaaagcttgagctgcaattaaaccaccggaaaggataacgaccatccaaatgccgttgatatatgctccatgtttattaactttaaggagtttcttagggatgaagtttttagcttctttactacctaataacattctaagtggagcatcgatactaataactaaggtagaaaattgtccaataacgttacaccatgaatagatatacataaacaagccaccaacatggtaatattcacccaaacgctggaatgccatataagcaccgtttgaaatatattcatttaaattattgttaacaatcttaggatcaaacatcaaagccatggcaaatgttcctaaaatagcagaaatcataaccataatagcaagagccatcattgctttcgggaagttttttgaagggtctttaactttatttacatagggagatattttttcacatccaccaacggcaaaaactagaattgaaagagaagttaaatacttaagattgaatgttggcattaaacttttccaattaaagttaattgaataatatcctgcgtgagggttaattgctggagcagcaaacatcataattataaacaaaatagacatgataaacattgatgatccagcaatagtggctaaacttttaagaacaggaattcctttactagtgacccagcagaaaaataggaaaacaactaaagtagcaagttgagtccaggccgttgggagaccatcataccatttggtatttccaaaaattccccaagccatcgctcttaagccgccggtacctttactggaaatataaacgacgtgacaagcccaataggtccatccggcataatatgcccattttgcacccatggtcgcattaacccaagatgagacaccaccatttgcatttttaaaggtagcgcctaattctccaaccattaatgcatagggaacaaaatagagtaaaaacattagaacccagctgaaaacgaccttagtaccatcgaagtaaacataaccatttacaacattgccaaagccccaaacagttgaaaatgccatcattgccagtgtaggccaaagcatttttttggcatcagactttttttcttcttcgatcataaaataacctttctgtctatgtacataattaataccgattttaattataacgaaaatgcttacaaatgataggctatttctaaataaaccgagtaattaaatgatacaaaaaaaggagccagcatacgctagttccttttatgcgccccctgagagtcgaactcagattttaagaaccggaatcttacgtgcgatccattacactaagggcacgacaaactaaaataagtatatcagaaaatgtagaaagtacaaattaattattctgaatgatatatcttgaatttaaaaaaagatattgctatactaaaaactgtcgagagagaaatgtgaattgaaatatagttaattcgcgtctctctaatatttttaagctttttgggtcgcttaccgtcatatggcggtatcgcttttgacccaatagagggagcgagcaatggactcggatttaaccttgttgcaaagcttagttcctgatgttttaaaaataattcggcaacgttttcttgttcttgaacagatttcgctgttagctccagttgggcgaagagttgttgctaaaaaattaggattaagcgagcgcaatgtgcgaactgaaactgattatttgcggcagttaggactcattaatatccagagctacggtatggaattaactgataaaggaaagagaactttaaaggaagctgctcctttaatcgatcgtttgtttaacgctagtcaaactgaaattgaattggcacaaaaattagggatcgatcgagctattattgttcctggtgacatggatcgacaagagcgcgttgttgacttaatgggtgaacaacttaactctgcgcttgatttacttttaccattaggaaaaagtattattaccgttttaggtggtactactgtggcgggagtagcccatcatctttctcctaaattaagccgctatcgggatttgttatttgttcccggaagaggagcagttggagaaagcgttgaaatccagagtaatactgttgctcagatgatggcttctgagacaggtggaaagcataaagggctatatttacctgaaaatgtttcatctgaggctttgactttattgcttcaagatacagatattgcgaatgcgatttcaaacatttataatagtgatatggtgatacatggaattggtagagcagatgtcatgtcaaaaagacgtggcttagatgtaatgactagttccaagcttcgaaatgatggagctgtggccgaatgttttgggtatttctttgaccaacaaggtagacttgtaaaacgtatcccacggatcggtcttcaattagaagacttagataaaatacctcatgtatttgcaattgctgctggggctagtaaagcttctgcaattgtagcttacatgcatcatgctcctaaacaaacgtggttaatcacggatgaaggagcctcaaacttggttttaaaggggaagtaattcccgtttaaaataaattgttacttacatatttcctaaggaggaatataggatatgacagttaaaattggtattaacggtttcggccgtattggtcgtttagcattccgtcgtattatggatttaggcgaaaagtcttcagatattgaagttgttgcaatcaacgacttgactactccagcacttttagctcacttacttaagtacgactcaactcatggtactttcaaccacgaagtttcagcaactgatgactcaatcgtagttgacggtaagaagtaccgtgtttacgctgaaccacaagcacaaaacattccttgggttaagaacgatggcgttgactttgttcttgaatgtactggtttctacactagcaaagctaagtcagaagctcaccttaaggctggtgcaaagcgtgtattaatttctgcacctgcaggttcagacttgaagaccattgtttacggcgtaaacgatgatactttgactgctgatgacaagattgtttcagctggttcatgtactactaactcattagcaccaatggttaatgctttacaaaaagaattcggcattgaagttggtactatgactactatccacgcttacacttcaactcaaatgcttttagatggtcctgtacgtggtggtaacttacgttctgcacgtgctgcagctatcaacattattcctcactcaactggtgctgctaaggctattggtcttgttgttccagaattgaacggtaagttgaacggtcacgcacaacgtgttccagttccagatggttctgtaactgaattagtttcaatcttaagcaaggatgtaactgctgacgaagttaacgaagcagttaagaagtacgaaagtccttcatttgcatacaacgaccacaacatcgtttctagcgacgttttaggtatgactgctggttcaatctttgacccaactcaaactatggtaactactgcaggtgacaagcaattagttaagactgttgcttggtacgacaacgaatactcattcacttgccaaatggttcgtactttattgaaatttgctactctttaatcattaattattaattactgattttaagtaagcagacgagagaaggcggagggaattacttcctccgccttttttcaaataatctatcggaggtaaattagtttaaatggctaaattaatcgtttcagaccttgatcttaaaggtaaaaaagttttagttcgtgttgacttcaatgttccaattaagaatggtgttattggtgacgacaaccgtattgttgctgcattaccaactattaaatacatcattgatcacggtggtaaagcaattttgcttagccacttgggtcgtgttaagtcagatgctgacaagaaagaattgtcattacgtccagtagcagaacgtttaagtgaattattagaaaagcctgtaacttttgtaccagaaaacgagggtaaagaagtagaagaagctatcgacaacatgaaggatggcgacgttgttgttcttgaaaacactagattccaagatattgacaacgactttggtaagcgtgaatctaagaacgatccaaagcttggcgaatactgggcaagtcttggtgatgtatttgtaaacgatgcatttggtactgctcacagaagtcacgcttcaaacgttggtattgcaactgctatgaagaaggctggtaagcctgcagcagctggttacttacttgaaaaggaaattaagttcttaggtgatgctgttgaaaacccagttcacccatttgtaactattcttggtggtgcaaaagtatcagataagattggtgttattgaaaacttaattcctaagtcagatcacattttaatcggtggtggtatggcttatactttcttagctgcacaaggtcacaagattggtaaatcattatttgaagctgacaaggtagaacttgctaagagcttgcttgaaaaggctggcgacaagatcgttcttccagttgataacgttgctgctactgaattctcaaatgatgctcctcacgaaattgttggtgatgatattcctgacaacgaaatgggtcttgacatcggtcctaagactgttgaaaaattcagagacatcttaaaggatgctaagactgttgtatggaacggacctatgggtgcattcgaaatgccaaattacgcagaaggtactttggaagttggtcgtgcattagctgacttaaaggatgccgtaactattattggtggtggtgactcaactgctgctgctaagcaattaggaatcgctcctaagatcagccacatttctactggtggtggtgcttcacttaactaccttgaaggtaaagaattaccaggaatcgcttgtgtttctgacaagtaaaattaggaggaatttttaatgcgtacaccaattattgctggtaactggaaattacacatgaaccctgaacaaaccattgaatttgttaatgcagttaagggtaagttgccagatccaagtaaagttgaatcagttattgctgcacctgcagttgatctttatgttttaaagaagactgctgaaggctcaaacttacatactggtgcagaaaatgcatactttgaagttgaaggtgcctttactggtgaaacttcacctaaagttttgaatgaaatgggtattgactactgtattattggtcactcagaacgtcgtggttacttccacgaaactgatgaagacattaacaagaaagctaaggctttatttgctaatggcgtaactccaatcatttgctgtggtgaatctcttgaaactcgtgaagctaacaagcaagatgaatgggtagtagctcaaattaaagctgctttagatggcttaactgcagaacaagtttctaaacttgttattgcttacgaaccaatttgggctatcggtactggtaagactgcttctgctgatcaagctgaagaaatgtgcaagactattcgtgaaactgtaaaagacttgtacaatgaagaaactgctgaaaacgttcgtatccaatacggtggttcagtaaaaccagctaacgtaaaagaattaatgtctaagcctgacattgatggtggtttagttggtggtgcttctcttgatccagaatcattcttagcattggtaaactaccaagattaattaacaatttatttaaacggaattagaagaaaaaaggagaatctccatgtctgttattactgatattcacgcacgtgaagttcttgactctcgtggtaatccaactgttgaagctgaagtttacactgaattaggtggctttggtcgtgctatcgtaccatctggtgcttctactggtgaacatgaagcagtagaattacgtgatggtgacaagtctcgttttcttggtcaaggtgttttaactgctgttgaaaacgttaatggtgaaattgcaaaagctgttattggcttagatgtaactgatcaacgtttaattgaccaaactatgattgaccttgacggtactccaaacaagggtcgtttaggtgctaacgctatgttggctgtttcattagcaagtgcacgtgctgcagctgatgaattaggtttacctttatacgaatacttaggtggaccaaacgctcatgttttaccaactccaatgatgaatgttattaacggtggtaagcacgccgataacaacgttgatatccaagaattcatgattatgccagttggtgctaagtctcttcatgaagctgttcgtatgggtgcagaaactttccatactttgaagagcttgcttcaagaacgtggtgaatcaactgctgtaggtgacgaaggtggttttgcaccaaacttgaagaacaacgaagaaccatttgaaattttagttgaagctattcaacgtgctggctacaagcctggtcaagatatttctattgcatttgactgtgcagcttctgaattctacaacaaggatactaagaagtatgtgactgttgctgacggccgtgaatacactgctgaagaatggacttcacttatggaagacatcgttgacaaatacccagttatttccattgaagatcctttggacgaaaacgattgggaaggttggaaagtcttcactgaacgtttaggtgataaggtacaaatcgttggtgacgatttattcgtaactaacactaactaccttgaaaagggtattaagatgggtgttgctaactcaatcttaattaagcttaaccaaatcggtactttgactgaaacttttgaagctattgaaatggctaaggaagcaggctacactgctgttgtttctcaccgttctggtgaaactgaagatactacaattgctgatttagttgttgcaactaatgctggtcaaattaagactggttcaatgtcaagaactgatcgaattgctaagtacaaccaattaatgagaattgaagaagctttgggttcaactgctcaatacaaaggaattcacagtttctacaacttacacaaacaattttaattaatagttgaaataaaagaaaaagggacgttgctttaggtgactccctttttcttttagcattcattggctaaatatggtaaaatcagtacagtaagaaatttaggtaatggaggcagcgctttgtataatatcgtcatgacgctactcatcattgttagctttttaattattattgctacgttgatgcagccgcaaaagcaacaagatgccttaaacgcattgtccggcggtgcagtatttagcggccagacaaagaagcgtggatttgaagcattaatggaaaggattaccgctgtattattggttctcttttttgctcttgctttgatcttggcagtactttcatccaagtaaaaaaagccttccggtcacaggagggcttttttaatttcttttaacttaacttattttataaagaaattgaggcaatttatataatgacacagaatgaacgagttttagctgatgtttatgaaacatttagacataatcctcaagaacaatatgatgtggatcaacttgaaaatgatcttagtcgtagccaaagattgaattttcctgatttggttaaagctttaacttttttagagcatagtaaaaagattgtaactgatggtcagggaaagtaccagttgaatcaattaaacactgttgctgaaggtacctttaaggcaaatgataaaggatttggttttgtcagatttgatgatgaaagcatggaagatgcctttattgataaacataatactaaatttgctattgatggggaccgcgttaaggtaaaaattattgctggtgctaatccatggaatggcaaaggtccagaaggtaaaattgaagaaattactgaacgtggtgtagaaactttagttggagaatttcatccatactctgatgaagtagtgaaatcaagtggattttacggttatgttgttagtgaaaatagaaaattaaagaaatataaaattaatatcactgataatggtgttaagccacaaatgggtgatatggttaaaatttctattactaaatatcctgatgaagatcaaccagatgaaatgcagggtgtagcacttctcacaatcggtaataagaatgatcctggtgttgatatcatgtcaattgttgttgataatgatattcggactgattggcctgaagaagcaatggatcaagcaaataacattcctgatcatgtaactgaagaagaaaaaagtaaacgggttgatattaccgatcaaccagctgtaacaattgacggtgacgattctaaagactttgatgatgcagtcgtagtttggaaactccctaatggtaactatcacttaggagtacatatagctgatgtatctcattatgtaaaagaaggcacaccgctagataaagaagcttttgctcgtggtaacagtacatatttagttgatcgtgttatcccaatgcttccatttagattgtcaaatggtatttgctctcttaatgaaggtgtagaacgtttagttctatcatgtgatatggaaattactccagaaggtaaacgtgttggatatagaatttatccatcagttatgaagtcacatggacgtttaacttacaataatgttaataaagttcttgatccaaataatcatgaaaagttagagcaaaagtatgcagatgcagcctcaatgcttcatgaaatggccgatttacataatattttgtataaaaaacgtcaccaacgtggggctattgattttgaagaaccagaagcaaaaattgtagttgatgataagggtaagccaacagatattgttcttcatgaacgtggaactgctgaaaagatgattgaatcctttatgttgatggcaaatgaaactgttgccgaagactactataagaaacatacacctttcctttatcgtgtacatgaaactccagatcaagaaaaaatgcaatcattctttgagtttgtaagtgcatttggactaaacgtaaaggctgatccaaatgatgtaaagccaaaagatttgcaaaagattgtagctaaaaccgagggtacacctgaagaagctgttgttcaaatgatgatgcttcgtagcttaaagcaagcacattattctcctgaaccactgggtcactttggtttagccgctaagtactatactcactttacttccccaattcgtcgctattctgatttaatggtccaccgtatgattcatgaatatgcaaatgaaaatatggatcaagatattcaaaagcactttaaggctcaacttccagatgttgctgaacaaacttcaacacaagaaagaaaatcaattgatactgaacgaagtgtaaacgatctcaagatgactgagtttatggctgataaagttggtcaaacatttgatgcaatagtttcttcagtaacaagttttggaatgtttattcaattgccaaatactgttgaaggtttaattcatatttctaatttaaacgatgactactataattttgatgaaaaatcactaactttaactggacgtaattcacataagcagtttaagattgggatgccaataaaagttaagttgattagagctgatgtggaacaacatcaattagactttgaaatttatgatccgaatgccccaaagcgtcctcaaagaagtaataatcgtggaaaacgtagctttgataaaggacgtaaaaatggtggaaacaagagaaataacaatacttctcacgtaaacaatggccataattttaagattcgtcatcgcaaaacaacagctgtcaagtccaataaaaaataattaggaagaaaacgatgaaacaaaaagcagataatttgattgctcaaaataaaaaagcaagtcatgattattttattaaagaaactcttgaagccggaattgcgttaactgggacggagattaaatcaattcgtgcacgtagaattaatttacgggacggatatgttcaaattattaatggatctgcttttttagaaaatgttcatattagtgaatataaagaaggtaatcgctataatcatgatcctttacgatcacggcgcttgttgcttcataagagagaaattgctcgcctagctggaattcaagctcaacagggaatggctattattcctttaaaagtctatttaaaacatggatttgctaaagttttaattggtgtgggacaaggtaagaagcaatatgataaacgtcaaactattaaaaagcgtgatcaagaccgtgaaattcatcgtaagtatgggatttagtaggtgaattaaatgattagaaaggcaaaattaactgattttcctttagtttatccaattttaaaacaaatctttgacgagatggatatggatactattaaagctcttccagagagtcagttttatgatttaatgaaacatggcttttattctcctcattatcgttactcacataatcgtatgtgggtagaaaccgatgatttagatcgaccaattggtttaatagtaatgtatggttatgatgatcaaggtttgattgatatctcattaaaaagtgcatatccgaaagttggattacctcttgatgcagttattttttcagataaagaagcactcccgcatgaatggtatctggatgctattgctgtttctccaaaacattgggggaagggaattggacagaaattaattaaaatcgcccctgggatagcacgccaaaatgggtataaaaaaataagcttgaatgttgatcaagataatcctagagctgctcgcttgtacgattatatgggctttaaaacgacttctaccatgacgatcggggatcgtatgtatgaccatatgattaaaaaagttaattaaaacaaaagagaatcaatcactaaagaaagattgattctctttttgttattaaatttaaagaaatatttaaaaataacactaattacattattaatgttgcataccctttaaaaacctgttaaagtaataaaactatgtaagattggagagtgatcatagtttaattagaaaggaaattagaatgaaatgctggatgaattacaacgagttcaaatagctttacatgatatgttatctcaaccagacctaaagaaaataaatatttctaaactttgtcttgaagcaggaattagtagaagaactttctatttacgatatggaaaaataaataactgtattgaagcttgtattttactagagctgaaaaaagaattacgtaaaaatgaaaagaatagtttaagacaaattcttaatagtttatgtagctatattcaaaaacataaacaatatttctataatgcatataatttcagtgaagaaaactgtatgtgtgaaaagatgagggaacacttttttcaatatattcgctcatatgtttacaagcgaggaagtttttcagagctcatccttaaacaattgactaatatcctctatgatcgaatttgtttttggattagtcatagctgcaataaaagttatagttatttattggaagatttagcaatcattattgaattaattgattttcaaaagcacgtttgttctcatcaatatcaagtgtttaatttctcacattattatttaaactgtgattaagaaagtgcattaatttgattttgaaaattaaaagttggcaaaaatagtggtttagtatgccactgtgtaaaaagcaaactaattaaaataataaaggggacgtcttcaggacgtgagatatcacagctccaggtaagccccacgtcagtgactagtgaagaaacgctagccacttttttaatacctgagtaaaatccgtatcttccttgttttaaacttcctttgatccaataatttaaccgagtaatatagaataaattagtaaaacgactattaagtttttttactttgactagagaatgattgactacatcaacactataacttgctaaaagatggttagagtctaaataaagtcgaccaatttcattatggttaatatcagttaaaatgattggttggttaaattcattaagattaccttttaagatataaactatttcaccctgatcattttttactggaatttgaccacaagtttgaccatgtgtaagttggacagtataacgcataatttcatctgcctttagaaaaattatgttaatttacaaaaatgacgaattgcgtatgcaactccattatcattgttacttttagtaataaagttagcaattttcttgatttcaggcgcagcattttccattgctacacctacgccagccatgcgaatcattgattcatcattaagattgtcgccaatggccattacttcatttggttggtagccttgcaagcgagcataatccattaaagcaatccctttttgagctttaatattgttaatttcgatattagtagaagaactcgcagtgacaattaaatcacccatttttccgatttcttcacgaatatgtttaaatactttagggccatcaggatgaaaagcaacaaatttcatggcttcaaagtctggtttttcaagcaaatctttaaagtcagaaacatatttaattctcatgatttcatctgagccagcagcaaaagaaactgcctttttaaaagttaattttttgttgagatcaaccaatagatcagaaaagttagcaattctgcgcaaacgagaatctgaataaacattatctgcagcaactatttcaaagtaaaaaccagaatctttgagtaatttattgatcttaatactttggtctttaggaattggttcatttacaattagttcgccagcagtattaaagatcattgcaccattcaaattaatgaatcctgtatgaagtccggctttagcaaggatgccctgagattcggaaggcgcccgacctgttgcaactaaaaattcaacgccttttgcttgtgcttcttttatagcagcaatattttcagatgaaatttgcatttgtttatttaacaacgtgccgtccatgtcacttgcaataagtttaatcattttaagtcctccaatcttttatctatatgatatcatgaacttggatttcttagagagacaagaggatagaataagtatgaaaaaattaattggaaatgattgggatgaagttttagcaccagcttttgaaagtgaaaagtatcaagaattacgtgattttttaaaggaagaatatcaaacgaaacagatatttcccgatatgtatcatatttttactgcttttaaattaacaagttttgcagatacgaaagttgtaattttaggacaagatccatatcataatccaggtcaagctactgggatgagctttagtgttaatccaggagtgccattgcctccatctttaaaaaatatttataaagaactatatgatgatgtgggtgcagttccagtaaatcatggctaccttaaaaagtgggcagatcaaggagtattactgttaaatgcagttttgactgtaccatatggaaatgctaatgggcaccgaggtaaaggatgggaactaattacggacacagccattaaggcgctaagtgaccgaggaaaagttgtcttcattttgtggggaaaatttgcacaaaataaaattcctttaattgatgagggaaagaatgtaattatcaaatctccccaccctagtcctttttcagcagatcgtggctttttcggttcacgtccgttttctagatgtaatgatgctttgattaaatttggtgaaagtccaattgattggcaattaccacaagaagtaaacccagcagatatggcatagtttttgttttgagaaaaagctttgaaattgtaaaatattatctataaataaaaaaagaaaggcttaatttgttatgaaagtatttgactcacttaagaaaaaagcagaagaatcaaagaaagtaattgtttttccggaaggaaacgatgacagaataataaaagctgctgttcgcctcgaaaaagaaggtattgttaaaccacttttactgggaaagcctgatgaggtaataaagactgctcaaagcttgaatgttgatctaggctcaattgaaattattaatccggcagtttaccctgattttgaaaaaatgtgtcaagactttgttgagctaagaaagggaaagaatactttagccgaagcaaaggaaattttacaagatgtttcttactttggcacaatgttagtatatgaaggaaaagccgatgggatggtttcaggagctactcattctactgctaatactgtgcgtccagctcttcaaattattaagactaaaaaaggtatgagccgtgtctcaggagctatgatcatggaacgcggagatgaaaagtatatttttgctgattgtgctattaatattgatccagatagtgaaactctagctgaaattgcttatcaatcaagtaaaacagctgaaatgattggtcttgagcctaaaattgcaatgcttagcttttcaactaagggatcagcaaagggcccaatggtaactaaggtgcaagaagcgactgagttagtacaccaaaaatatccagacttaatttgcgatggagaattacaatttgacgctgcaattgttcctcgtgttggagaagcaaaagccccaggttctgcagttgctggacacgcaaatgtgtttattttcccagaactacaatctggtaatatttcttataaagtggcagaacgtttaggtggatttagcgcaattggtcctgtattgcaaggtcttgctgctccaattaacgatttgtcacgtggatgcaagacggaagatgtgtatttattagctattttaactgctgctcaagctaatatggagaaataaaatgaactcattagaaataaattctgatgaacagatgcaaaagttaggcaacgcaattggtaaaagtagtaagggtcatgatttattactcttatctggtgatttgggtgccggaaaaactacattaactaaaggaattgcaagagctttaggaattaaacgtcctgttaaaagtcccacttttacaattgttagagaatatcgggaaggtaagagaccgcttttccacatggatatgtaccggctagaagatggagacttgtcaagtattgatatgcccggatatctagctgaagatgggttggtcgtaatcgaatggccgcaatttattattgaagacctacctaacgattatcttgaattatcgattaagcgtgtagatgattcatgggattctaccaagcgaatagttgaatttaaagctgtcggagaaagaaacaagctttggttgtcagaaataaaaaaatattttgaataataaaaaatggttaagcttagataggcttaaccatttttttgattggatcatctccaacacgtttattttcctcaattaaaatacctgcacaagcttcgctatcgcttaaagcattatggtggtgccataaattgatatttaaagcttctgagactgtatctagtttgtgattaggaagatagggctcaaaggctttactagttgctaaagtatcaattgcaaagtagtggggtgccggaatattatagcgagccagcgatttctccattacgcggcaatcaaagcgagcgttatgggcagctactaacattcctggttgatataatttttttatttttggccagacttcagccattgttggagcgttttttacgtcttcagctgtaatgccatgaatttttatatttcttccatcaaaaggcatttgtggattgataactgtataaaaacgatccacaatttcattatttctaaccataactaaagcaagagaacaggcactttccggatgactgtttgccgtttcaaaatccattgcagtaaagttcatttttatcctctaaataaaacattatttttctttttagtataacacttaaggtagaaaactatccatttaatgcggtatgattaaagagatgattatttaaggaaaagagagataaaaatgcaactgatggatttaagaaaacaggggattgacattcaagaaaatattccattgagccgttttacttttactaagacgggaggacctgcgcagtatcttgcttttcctaaaaatttaaatgagctcgaactattagtagatacggttaaagaaaataatattcccttaactgttattggaaatgcttctaacttgatcattagagatggtggtatttctggtttagttttgattttgacaaaaatggacacaattgttgcaaataaagatgaggcaactgttacagcggatgctggggcaagaattattgatacatctgaagcagcatgtgaagctggtctaagtggactagaatttgcggctggtattcctggtagtgtaggaggagccgtctttatgaatgcgggcgcctatggcggtgaaacagaatttgttattaagtctgttcgtgtcttaactcgtgctggtgaatttaagacttacacacatgatgaaatggaatttggctatcgtcactccttggttcaagaaactggagatattgttgtgagtgctacttttggtcttgagcccggagataagtgggctatcaaagcaaagatggaatattttaatggtttacgcagagcaaaacaacctctagaatatccttcttgtggaagtgtttttaaacgtccagcaggacatttcgtaggaccaatgattattaaagcaggtctgcaaggtaaaagaatcggtggagcagaagattcaatgaagcatgctggctttatcgttaatgttggcggtgctacagctactgattatttagatttaattcatttaattcaaaaaacaataaaaaaagactttggtattgatttacaaactgaagtaagaattattggaaaagaaaaagattagatactagtacaaagctacaagtaacggcttgtagctttttttatgagatagatggtgagaaaaaattgagcgatattattaaattaaagcatgttcgtaaggaatatgatgatggttttgtagcactaaaggacattaatttaacgattgaatcgggaaaattttattctttattaggaccatcgggttcggggaaaactactattttaagaataattgctggatttagcgaaccaacgagtggacaagttttttttgatggacaagatattactaatttagatgctgctaaaagaaaaattaatactgtttttcaaaattatgctttatttcctcatatgaatgtttttgaaaatgtggcattcggtttacagatcaagaaaaaggataagcaagaaataaaattagctgttaaagaagctttacacatggttcaattggatggctttgcaaaccgagaaatttctgaattaagtggtggacagcagcagcgagttgcaattgctagagcaattgttaatcagccaaaggtactacttttagatgaatctttatctgccttagataaacgtttaagaaaagatatgcaatttgaattacgtgaaattcaaaaaaagctggggattacttttatttttgttactcatgatcaagaggaagccctagcaatgagtgatgaaatttttgttttaaatgaagggaaaattcaacaaagtggtagtccggttgatatttatgatgaaccagttaatgactttgttgctcgctttattggcgattctaatatcttaagtggacggatgattaaggattatgaagtggaatttggaaatcatcgttttgaatgtgctgatgcaggtattaaacctggtgaaaaggtagaggtcgttttaagaccggaagatttagatatcactgatattgaacatggaaaactaagagttgtggttgaaagtcagctctttttaggggatcattttgaaattaaggccattgatagtgacgaaaatgaatggttaattcactccactaatccaactaaaattggtaaggaagtaggagtatattttgatcctgaagatattcatgttatgcgttttggcgaaagtgaagctgaatttgataagcgtttagaggcatatgaaggagaggagtaagatatgaaaaaaagtaaattgttttttctcattccttatattctatggcttgggttatttgttatcgccccgattattttgattacaattaatgcatttaaaggggatgatggctttactttaaagaattttcagcaattttttgtcaatggtacttttttaagaatgactctaaattcattttggtatgcattcttaattaccttaattacgctgctaatttcttatccaattgcctatattttaagccaaatgaaaaaccaacaattttggctgttattgattattttgcctacttggattaacttgcttttgaaagcttacgcatttattggcatttttagtaagcatggactattgaataattttctacgcctttttggaatagcacctgcaaatattttgtttactgattttgcctttatttttgttgcagcttatatcgaaattccatttatgattttgccaatttataatgcaatttgtgatattaatcctgctgtaattcaagcggcttacgatttgggtgcaagtaaatggcaaacatttattaaagttttatggccactttcaaaatctggagttgagtcaggaattcaagcagtattcataccttcactttctttatttatgctaactaggttaattggaggaaatcgagtaattacccttggtactgcgattgaagaatactttatgacgactatgaattggtcaatgggttcgacaattggtgtggtattaatagtgttaatggtgattgttatgctctttacctcatcagatcatcatcataaaaaggagatcaaactatgaaaaaaataaaatggtcccgaatctattttgcttttgttctggttttgatgtatttacccattttttatttaatattttattctttctcaagtggtcataatatggatcattttgaaaagtttactttaagtcattatcaggatctttttaatgataataggctattagccatttttctagaaacaattttactagcactcttatctagtttgattgccactataattggtacttttggagcaattgcaattagtcagactaaaaataaaaaaggacgaaaaactttgctagccttaaataatgttttgatggtatcaccagatgtaattatcggggcgagttttttaatcttctttacttttttagggattggcttaggttttggatctgttttattaagccacattgctttttcaattccaattgttgtattaatggttttgccccgcttaaaagaatttgattattctttagtagatgctgctcgagatttaggtgcatccacttggcaagtttatagcaaggtaatgattccggctattacgcctgggattttagctggcttttttatggctttgacttattccttagatgattttgcagttactttttttgtgacaggaaatggtttttcaacattgtcagtagaaatttattcacgtgcgcgccaaggaattaacctagaaatcaatgccttgagtactgtgatgtttatttttgtaatgattttagtacttatttattatgtaattactaatcataaaacccatattggtaaggggcgtgcacaatgaagaagctgttaattggaattgtgactattctattggtttgttttggcttagaagctggggctaaacaattaaataataatggtgttagcactaataataaaaatttgattatctataattggggtgattatattgaccccaagctaatcaagaaatttgaaaaacaaactggatatcatgtaatttatgaaacatttgattctaatgaagcaatgtacacgaagataaaacaaggtggtactgcatacgatatttgcgtcccttcagactacatgatttcaaaaatgcgtaaagctaacttacttgataaaattgacactaagaaaattccaaattacaaaaatattgggagtgagtttttacatcactcttttgatcccaaaaatacctactctgttccgtatttttggggaacgttaggaattgtatataatgataaatttgtaaaacctgggcaaataaagcattggaatgatctctggtccaaggattatcggcataatattttattagttgattctgctagagatattatgggactctctttagcgtctatgggaaagtctttgaatactactaattccttagatctaaaattagcaaaaacaaagttggacggtctcggccccaatgtaaaagcaattatttcagatgaattaaaaatgtatatgattcaaaatgaagctgctgttggagtaacgtggtctggcgaggctcgtacaatgctaaacgataataaacacttacattatgtagtgccacctgaaggctcaaacttatggtttgataattttgtcattcctaggaccgtaaagaataaaaaaggtgcttatgcttttattaattttatgcttgatcctaaaaatgctgctcagaatgcagagtatatcgggtatgcaactcctaatgtaaaagctcaagaattattaccaaaggaagtaaaaaacgataaacaattttatccaagtaaacaagcaatgaaaaatttacaagtttatcaagacttaggtccaaagaaaattcaagaatataatgatctatttctcgaatttaaaatgtatggtcgataagagcttggtttatttataattgaattttaggagggtggcaatgaagtttaatattgagcaaatatttacctggcaaaacctgatgaatattattgatattttaattgtatggtacattatctaccgtttaattatgttggtaagagggactaaagcagttcaattagttaaagggatatcattaattattctggttagaattgtagctgggttgttacatttacatacgttaacgtattttgtcgatcaaattctttcttggtcagtaattggaataattgttattttccagccagaaattaggcgtggcttagagcatttaggtagatcaccaatttttggtgggactacaatgactgaaaagcaagctgctgaaaagatgattggagaattagataaagcaattcagtatatgtcaaagagaagaattggtgctttgatcacgattcaacaaaatacaggactagaggactatattgaaaccggtattccaattgatgctgatatcactggtgaattattaatcaacatttttatacctaatacgccattgcacgatggtgccgtaatcattcgcaataatcgaatagcagttgctgcagcttatttacctctttctgataatagtatgattcctaaaaaacttgggacacgtcaccgtgcagctgttggtatctcagaagttaccgatgcaattactatcgttgtttcagaggaaaccggtggagtaactattactcgtaatagccagtttatgcttgatctaactagagaagaatatttgaaatatttaaatgctcaattagttccaaaagaggaagaagaaaagccaaagtggtatcaaagaattgtaaatcatgtttggaattgggggtcaaataaaaaatgaaaaagttttttgataaaccttggttctatcgaattattgctttgattttggctattttattagctgtttatgtagcatctaatcagcaaggttatgttactcaaggccgacgtgaagaaaccttaaaaactgcaactaaaacccaggtaattaaggtacccttacaagtttcagttaatacggataagtactatgtaacgggatatcctgaaaaagtaaatttaactttagagggatcgaatgctttagttacatctactattaatactcaaaacttccgtgtctacattgatttaagccatttaaaaacaggagagcatactgtaccaattaaggtaaatggtttaagtagtcaattaacttataatattagcccaagtaaagtacgcgtaaatattcaaaagagaaaatctcgtactcttcctgtacaaatagagtataataagagtgctgtagctcgtgggtataatcttggaactgctaaaagtgatccagaagtagttaatattactggagctaaaagcgaagttaaccaagttgatcgagtagtagctcgggcaaatttaccaaagggaatagacagcacatttgaacgtgaagaaatgctggtagcacttgataaagatggacatcagcttaacgtcgttatggatccagtaacggcatatattactatcccaattaacttatctaagaagaaggttaagataaatgtaacgtcgaagaatgaatcttcgactcatgtttattctttaaccgcaaagaaagaaaatattgagatatatggtgatgaaaatacgctcaagaaaataacgtctcttcctttaaaggttgatttaagcggtattgatcatgatgttacgaaaaatgtcacacttaaattgccagatggcgttgttaaggcatcaccatcagtgataccagttcatataaaagtaactgatactactgctaaaaaagaataaaacaaggaaaggttgttaaaaattatgcttaaatattttggaacagatggtgtacggggggttgctaatgctggcttaactccagagatggcttttaaattaggtcgtgatggaggatacgttcttactaaggataaaaaggatggagaaagagctaaggtattagtttctcgtgatacacgtatttctggacaaatgttagagtatgcattgatttctggtttgctttccgtcggaattgaagttttagaagttggtgtaattactactcctggtctttcttacttagtacgtgcacaaggtgcagatgctggtgttcaaatttcagcttcacataatccagttgaagataatggaattaaattcttcggcagtgatggcttgaagctatctgatgctaaggaagaagaaattgaaaaattaattgatgcgcctgaagataaacttccacgtccttctgcagaaggtttaggaactgtaacaaattaccatgaaggtgcttctaagtacttacaatttattgaaaatactttaccagaagaattaagtggaattaaagttgttgtggatggcgctaatggtgctgctagtgctttgatttcaagattatttgctgatatgggggttgactttactaccattgcaactcatccagacggtttaaacattaatgatcatgtgggcgcaactcatactaagaaattacaagaagaagttgtaaaacaaggtgctcaattaggtttagcatttgatggggatgctgatcgttgtattgctgtcgatgaaaatgggaacgaagttgacggtgatcacattatgtacgttattggctcatatcttgctgatcatggtcgcttaaagaaagatacaattgttacaactgtaatgagtaaccttggttttacaaaggctttggaaagacgtggtcttaaaaatataagaacacaagttggtgaccgttatgtttcagaagaaatgagagctaatggttataatcttggtggagaacaatcaggtcacgttattattagcgactaccacaacacaggtgatgggatgcttacgggattacatttattatatgtaatgaaggataccggtaaatccctcagtgaattattgagtgactttaaagaatacccacaacgtttaattaatgttcctgttgaaaataaaaaagactggaaagaacataaacgcattactgaagccattgaaaaggttgaaaaagaattaagtgatgaaggacgtatttttgttcgtccatctggaactcaaagtttgcttcgtgtaatgactgaagctccaacacaagaattagctgacaagtactgtgaagaagttgctaaggttgttgaagaagaaatgggttcaaactaaaaactaattatttttggctttatttaaaatttaatatggtgatggtgttcaccaatttaaccgattaatatctgacgacgcctactttcttggatcaacagggaggtagtgtcgtctttttttatgcattttttgtataatagaaaggagagtaaccgattacataaggagaaaagctaatgaatataaaattaattgctgtagatcttgatggaacattattaaatgataaacaagaaataagtgttaaaaccaagcaagcacttcaaaaggcatcaaagatgggaataaaaatagttccttgctcaggtagaccatttccaggtattaaggactatcttaatgaattggacttaaaggattctactcagtatgtggttgcatttaatggagctttagtgttaaattctcaaggaaaagcaatcgttgaagaactgttaagctataatgattttatcttttttgaaaagattgctgataaattacaagcaaattttcatattgaagtaagagataagtttattacattagatcattttattaactattatctatcacgtgaaagttggctaacaagaatgccaatagaggtttctgaactaaaagatatttcagaagatattaaatttactaaggcaatgttttcaggatctccagctgaaatgaagaatatttatgggaatttatcagaggaagtatttgaaagatataatgtctcaacttcagatgaaactttgattgagattaattctaagcatgcatctaaaggaaatgcgttaaaagagttagctaaaaaactaaatttaaaagaagatgaagtaatgatttttggtgatcaaactaatgatatttctatgtttgatgtgccgggattctataaagtagctatgggaaacgcggtttctgagataaaaaagcgtgctaattttataactaaaacaaataatgaagacggaatagcgtatgcattaagaaggctggtttttaatgaatagacgattgaaaaattatttaagtgtagggatttttgctttttttggaggtggactgcgagcctatttaaatttaatctggtcacagactggaactttgactgctaatattatcggctgctttttattagcattttttacttatttttttgttgaataccgagaaggaagagattggctagttactggactaagtacaggatttgttggttcctttactactttttcaagttttaatttagatactcttaagcaattagaaagtgggatgaatagtcaagcaactatttatttctttagttcgatctttattggttttttatttgcttatttgggaatgttagtaggtaaaagaacaggtagaaagttggcagaaaaagcatgataacagttttaacagccggattcggagctatttggggagcaattttaagatatggcattactaactatggtaaaaaacattggtctgagaaatttccgtacgcaacgctattaataaatcttacaggagcatttttattgggatttattttttctcgtaaattctcaccctttatctatgctttgattggaacaggagtattaggcggttatacaacattttcaacgttaaacgttgaattgctgtctcattggcgagatcgtaattacagtgtattcaccctatatgcattgctatcatatggtggtggcttaattttagtatttttaggatataaagtaggtactttgatttagatctcaataaaaaagaatgtatcagattccgatacattctttttttgatagttattaattttgatttttaatcgaaacttttcctactttgcttgaaatatcaattaaattagttgaatcttccttaccaacatagccttcaattttatcgtaatcatcgtttccgtaaataatggcatcaagaggaaaatcagttggaccaatttttttggtattaattttgaatttgaaaaatattgccggtgggacattaaccgatatattaccaactttactttgaattgataaattaaatttagacttttcagccagtgataagttaattttccccaaatcagatttaatactaccacttccattaagattatttaggagtatgaatcctgtatcggttactaaatctatattctcgcttgtaactttatttacaacgattttgccacttttagtatctccaaaaaagtttttagttttaatattttctaattctatattcccactgactgtgtgataagatatttcttcttttgcatttacatcattgctgctaagtgtccccgaatgcccattaacatgaaagacattagctgaagtattagaaatggcaatgtctcctgattttaagtctgcttgtacgcgtttaagagtagagtgagctaatagaaaatctcctgaaaccgcagttacatctaccatacaataattagaaatcttattaatatagacatccccactttgactgcgaatagttagaaaaccagtgaactctttaggtaaaaatagcaaagttttatttttaaaaataccaactagtttgcgagggccttgggtaatttttaaaacatttccaactttttcaactgttgagtgtaggtttttaatatcgcgagacataaagtcatgtacgattagttgggaagaattggttggtaaaactaaaatatcacccaagcgatagttaagatgaatttcatcaatttgatttaattttatctttagttcattgactagttttgaatcgaaaattttggcgaaaaaatcattatattttacatagtcattttcttctaaagattttagttgagaaagcatggtatcaagatccgttaaatttaaaagtgctttttgttctgcttcaaattgactggcaccatgctgaatttctttttttattaagtttttaatttttttacttaaagtattttgtaaaggcttattttctttaatatgaggaaatttattgaaaaattcttttagtttttcatcaatcatgctgaactcctttgatatttgttacacttttattatatagcactaaaaaatctatggatttactttattaagtgtaaaaaataatcttaaaattttcattaggagaaaaaattgaaatttgtaaaatggatttggagattggttgtagttgggctcatctatatatcattgagtttaactttaactagtcccgtagaattaaaagtagacagcacagccggcttagtaaaaagttctattaataaggtggttgatcaagcaaataatagtgatttacaaatgggtgttagttttctgcaagattcaggtattgaagatacactcttgtcgcagttgcctaaaaatatcgaattaaagacatcttatcaaggattaaatcaattaagcaccaattatttggctaatgataagttaacggatgttgatctgaatttaaagaatgatacgcagcaggagcaagtttttaatcaagtcatattacaattggtaaatgaacagttgaggcaaaattctgattcggtaaaacaggctgctgagatttatcatttaatttacttcttgttgattggactatatattttggcaatggctttagctttgtttggaaaaaaagtagcccttattccacttttaattgcggctattggatcatatggtgttttatcttatgcagcccagattgccacgagttcgctgcatgaaagtgtgtatagcggaattaatgtaagcctaagcagtggattaacacaagctttaattaccgcaattattgcggctgtaggctgtctatttattaaaattaagcaggagcaggaataaaaatgctatttaagacaagtgataatgtagaaattaattaccagttaacgggaaaaggaaaaactattgttttggttaacggctttggagcctatcaagaaatatggtcagcacaagtcccatttttaaataaattagggtatcaagttttaacttatgatcacagaaatatgggaaaaagccaacgaacagaaaaaggtcatactatcgaacgtttgacacaagatttgaatgaattgacatcatttttgaaaatcaaacaagctatttttatgggacattcaatgggcgcttctatcatcttttgtttaatgaaaaataatccaaagctggttaaacaagcattgttaatagatcagtcacctaaaatgcttaatgatgaaaattggaaatatggctttatggattatacaaaagaaaattatttaaaaaaatgccaagaaaggccacgggttcatgaaacatataatggcttggatgataatgtgtatgctaagttaatgaaggccaagaaagccaatccatttaatagaaaagataatgtagatttgcttgaaaatcatatgtcattagattggcgaagagttttagaaaaaacaacaattccaactactttttttgttgcaaaggaaagtccttattatcgagagggatatgaaaagaagcttgaacaaaagaatagccgaataaatagctttattatgtcaccgacgggacatgtaattatggcggaaattccacagcaatttaatataaagttaaaagatattttaaagtaaaaaagagggtctcgtattagaggccctctttttaataaactaacttagtctagttttttattaatatttgctaaattctgataattttctgtcatccattttatgtaacttgtattgttggggatggtttcacgaacttgcaagattggaatattttttgacttagctctttttacaaaattattaacagttgaactgcttacttgagaatttttaacaaagaaagaaattccacgattattaattgtttggttcatttgatgaataattttggcacttggatctgtttcattttcaattgcttcttcaaaagctttatcaccaatcttaaagtgagtagcatttaaggcatagtcaaacactggctcgctgacatatactggcttttgttttgcaccatcaatagaatctgcaattttttgtatcttattgatttttgcaagatattccttcccattttctttgtagtaagctgcatgttttttgtctattttagagagtcgctcaactaaatagttaacatattttttaggcatgtttaaatcaaaccaaatatgcggatttgcgccattttttagattcattaaatcttcgccaactaaaacagcagacttattagttgatttagcaagcttaggaagccaagaatcatagcccaaaccgttagcaacaacaatttttgcattttgaactttttttgcgtctgcagttgtgggttcaaagtcatgtggatcagtagcactgttagtaataatagcagttgctttaccatattttcctaagacattttgtgcgatatcggcataaacattagtacttgttacgatagaaattttatttgatgaattttctttttttgagcagccagtaagaattaaaacaagactactaattgcaaaaaagaaagcaaaaatcttttgataatgttttctcattctatatatttatcctttcgaattatgttgtttagatctgcattcaatataaatcatagcagaatttactaatattttttaatttgctaatttatttttagtaattcgacttagtaagcttgtgttatagtagaaagaaattatgaattaaggttgataaaaaatgaaagctacaatatatatcacgggtagtattgctgcatataaggcaattagtgttgtacgtgattttcaaaaagaaggacatgaagtaagagtagcgatgaccgaagaggcagttcatttgattggaacacaaactttagctgctttaacgaagcatccagtattaactgatctctggaaggagaatagagctgataagatccagcatattgaattggccgactggactgatattgcggttgtagttccggcaacagctaactttattgcaaaaatagccaatgggatagcagatgatgctgcaagtacaacgtttttagcaactgctgcacctaaatatgttattccggcaatgaatagccatatgtggagtaatcctgcatttcaaagaaacttacagcaattaaagcaagatggaatctttgtaatggatcctgatactggccgtttagctgaaggatataatggtaagggaagaatgcctgaaccagcagcaatcatgaactgggtaaactcatctcttcaagtaaatgatgaattagctggtaaaaaagttgtaattactgctggcggaactgtctccccacttgatcctgttcgttatttagggaatcgctctagtggaaagatgggactggccttagcaaatgcagctcttagggctggtgcagaagttgttttgattgtaggacatgtttcagttcctgttcctgagtcatcaaaaatgacggttattcatgtagagacgactgaagaaatgcttgcagctgtgaagaaagctttttctactgcggatgctttaattatggcggctgctgtagcggattatgagccagtgaactacatagatcataaaattaaaaagcaagatcaaggagataaactaaaaatttatttaaaagaaactcctgatatcttaaaaacaatggggagtttaaagcaagaacagcaagttgtggttggttttgcagctgaaacaaatgatttactcgaaaatgcgactaaaaagttgaaaaataaaaatgcagatatgattgtagccaataatgttagtcagggagtatttggaagcgatagggataaggttacggtattaagaaaagataaagcaaatgaaaatatcgcagagacaactaaagtagaaatagctaagaaaataattactttagttgctgaagagcttgaaagtaggaaagttataaaatgaaaaaaactttgttaactaagcgagaaattatttttgtatgtttaatgattgctgtattactgggattgtttatttctagttcaatgacttatcatgagcaagagatgtcaccaggatttatacatcgtcattttccaattattgaaagaatagtaggaaattggaatatttattatggtggacgatggcataatgcagttttggacaatggtgaagctggggtgacacagtttgtcatgagaaagtttgctcacttttcatcttattttttagtgggtttgtttgcttgtttgggattagatcgattgtttaagaaatggtgtggtcctttatttatttggctaggtatcattggtttggccggattagacgaatttcaccagtatttaactggagacagaacacctagtgttcatgatgtagcgcttgattcagctggtgcacttttagcgatcttaatttgtatttttgtttattggcttagacatcgtgcagaaaaaagtaattcctagattgaatttaaacctttagtgcgttatgattgacaaggttaactatattaaataaaaagaaagaaggattcttatgtcaggacattcaaaatggcacaatattcaaggccgcaagaatgcgcaagacgctaagagaggtaaagttttccaaaaattatctcgtgaaatttatatggctgcaaagagtggtggtcctgacccttcaggaaatcctactttacgtatggttatggataaagcacgtgcagctaacatgcctaagactaacattgaacgtgctattaaaaaggctgaaggtaattcagatgaacattatgatgaaattacctacgaaggttatgcaccaggtggtgttgcagttttagttgaagctttaactgataacaagaaccgtactgcttctgatgttcgtgttgcctttactcgtaatggtggttctcttggtgcaactggttctgttgcttacatgtttgaccgtaaggggtaccttgtaattgatcgttcaactactgacgctgatgaagatcaagttttgcttgatgttatggatgctggtggagacgacttggaaactagtgatgatgcatttgaaatctacactgatcctaagcaatttactgctgtacgtgatgcattggaaaaagctggctataagttagctaatgcagaattaactatgattccacaaaacaccactccagttccagcagataagaaagagcaatttgctcatttaattgatgcattagaagataacgatgacgtttctaatgtatatactgctgctgcagatgatgatgaataataatttatcgcaaaatagatctaaaattatattttaggtctatttttttggactgacctttaggtcagtccattttttttgcaaattattttgaataataaaaaataattttgattttttgcgtactaataaatatagagtaaaggagggattaagagtgaatgagatgtcggaaagaattttagaagaggcgattgaaagacatgctagtgatatttttatctttcctattatcaatggatacgaggtaaaaattcgaactgcaatgggtttagataaaattcaagagttaagtcgacatggtggaagagagctcttaaattattttaagtttcaagcacagatggatatttctgaacggcgtagaccccaggtaggagcgtatcagaccgagtttaaaagaaaaaagatatttttacgtttttctagtgttggagaatttgccggagctgaatctttagtagttaggttgatttatggagaaaagaataataattattttcttccggagcagtttaatttaattaaaaaacttaccaatcaacgtggattaatagttacaagtgggccaacaggatcgggaaaaacttcaaccatgtatgagttagcgcaagtgattggaaaaaataaagttgtaatgactattgaagatccagttgaagtgtggaatccagacttcttacagacgcaggtgaatctaattgcggggattacatatcccgatttgttgaaagcagctttacggcatagaccggatattttaattattggtgaaattcgagatcaagaaacagcaaaaatcagtattaatgctgccctgagcggacatttagttttagctactattcatgctaagacggctttgcaaacaatatcgcgtcttgaaggattaggtattactaaagatgaactgagtaattgcttaacggcggtttcctatcaacggttattacctataaaagataaaaatgatgttgcttgtttaatggatattggatatggagaaatgcttaatcaagcaatcactaataacgataaacgtggtaatttgcatgattggcagaatagtttaaatcaattagtaaaacgaggaaagattagtgaaaaaactcagcaactttttgaagaaggataagttaaatagtgctgaccaattgatttttattgattatttaaggcaggctttaattaatggatattccttgaatgctagtttgagactattaccaaaaatttggaggggtaattctcgtcaacttctttatgtaaatcagcgagtagaagaaggaagccagttgggagacgtactgcaggaagtgggattttctagcactctagctgcccaaataaatctagcagttattgatggaaatctattatcttgcttagatcaaatgagtaaacttattcgattaaagaataagcaattaaagaagttaaaaggagaattagcctatcccgcgcttttggttgggatgatggttactttgctaatttgtatgcaaacatttctaaaaacagaaatgtctgataatgacttgactagtaatgtaatgcttggtggcctgatacttttggttattacagcagtattttttattagtaaaacaattagattacttaataaacaagattattatgctcttaaaaaactaacaaatttacctatgattggagctgttttacggttatatgttcattatctagttgtgtctgatttagcagttttattaattaatggtttttcactacaaaaaatctgtcaacttactgctatgcaacctgataggtcattacaacaagttatcggggtaaaagtaaaagatcaactagaaaagggtactgaaattaaagaaattattgagcaagaatttttcatacctaataatttggtcatgcttctagaaactggaacaactagaaaggaaattggaaaacgtgccttattgcttagcaagacacttttttatgaactgaatctaaaattgaatagcctaattctcaatatccaaccgatatgctttatttttattgggatttgtattttagggatgtatttaaagatattaatgccgatgtatcacttaatggaaactatgtagaggaaaaataaaatgaaaaaattaaaacaatttattataaaaaataagcaagtaaaaggatttactttagtagaaatggtaattgtaattgcgatcattgcaatgctaattttgctgattgtgcccggactaagcaaacaaaaagatagagctacgagtaagactgatgaggctttaagaacaacaattgagacacaaagacagcttgctgaagataatggagatggaacttccttagaagaacttgtaaagaaagagtatatttctcaaaagcaaaaagaaagatatgaaaaattaccacaaaaatgattttcaaaaaaacgagaggatttacattaattgaaacagtagttacattagcagtggtttgtcttctagtcttgatgccaacgctttatgtcaagaatatcaagggagcaggtggttttagataatagtacacgtcaagtgaaatctaccattaataagtatttacatctagcaacagtaaaaaagaagccatattttttgtcatattttgataataattcttcgattcaaataaaggaacctcataaggtttcgcaagtttatttagataaacatattagggtttacaattttgataatctttacattagcaatcgtggaacaatttcaccacggacgattaccattaagaatggtaataaagaaaagaaaataaaaatacaaatgacatggggaagaatggttgaagaataaaagaataaaaggatttattttctgggaagcatgtttaggatttacaattgcttgtttgggagtaattttattaggcttgacacttaagcaaaataggcaaacggaaaaacaaattgaaaaaagagtagataagtcctatgctgaatatatttttaaacatagtgataagaaaacattattagtccatgatcatgtctatcataggtaaaaataatgaaaagaataaaaggttttactttattagaggcagtttttgcaattgcggttacgattttatgtgcgcaaatactttttggactcgtaaatacacttagaaaaattaatcatcaaaaaagtggaataaatgaaattgcatatagttatgtacaagtaaataattttttaaaagaaagtgggcatgttgaagtaagtacaactggatcagacccaactaaaattattctcagaaaattttctgataaaaagaaaaagaagaatgatccaacttatgagacgtatgtgattgatttaagctcaaatgatactttaagaatgcggacagatgagggtggacatatgcctctattttttaaagttaaaaaaattagatgttctacgtcaaaagattcatttacaatcctgataactgaaaaagatggtagacaaagtgaaatgtattttaaaacagatttaccagaaaaaaaggaagtgaatccagctgatgagaaagaaaaaaagagttaatcgagtaaacgggagtgctttggttagtagtttactgcttattaatatctgtattacttttacgttaatgtaccagcatacttttactgaaaatatggaaagcaatctttctttaataaattatttctctaagtaataaggagtgcttgctagtatttgaggatacctatagaatattagaaggaatattaaagaaggaagaaaaatgcaaaaagtagaagaattgtatccaaaatttcagacagctattgagcatttacaaaaggctcttaatgtttctttttcatctgcattgacggaaacctttgataatttagaaaacggaaagatcaaagttgagtcaggtgctccagataaggaaactgtagctgaattgactgaagaatatcgtcaattagattatgataatttgccacgtgcattgaaagtacagatatttactttattagctttaaaggcaattactcaagatgctagtgactataacttaatgcctaccccctcagtagttgctacaataattgctttgatttggcaaaaaattgttcctactggtaaaaaaactgtagttgatccagctattgggactggaaacttactttattcagtaattagacagttaatacaagagaatcattctcaaaataattacaatctaattggaattgataacgaggaatctctcttagacttggctgatattggtgcgcatcttgaagatttaaagattgatttgtattgccaagatgcattagatccatggatgattgaaaaggctgatgttgtcttaagtgatctaccggtaggttactatccactagataataatgctcaacgctatgaaaatcatgcaaaagaaggacattcatttgcccatactttgttcattgagcaaattgtaaataatcttaagagagatggctttgcatttttagtggtaccacgattactatttactggcaaaggctctactgaattcatgacttggttagcaaaaaaagttaatattcaagctattgtagatttgccagataatatgtttttaagccaaattcagcaaaaatcaattttagttttccaaaatcatggagatcatgctgtggagcgggaagtactggtagctaaattagattcactaaaaggaccagaatctttagtagcatttaatatgaagttaaatgattggtatcataaaaataaagattaattttataagtatgtgaggtatatatatgaaaaaagttttagcagtaaattcaggtagttcatcatttaagtacaaattattttctcttgataatgaagaagtaattgcatctggtatggctgaccgggtaggattaccaggctctgtttttactatgactttagctgatggtagtcaacatgatgaacaaagtgatattgctaaccaagaagaagctgttcaaaagttacttagctggcttaaagaatataatgttattgattccttagaagatattgcgggcgtaggtcaccgtgtagttgctggtggagaagaatttactgatagtacagtaattactgaagataatctttggaaaatttataatatgagtgactatgcgcctttacataacccagctgaggcagatggtatctatgccttcatgaaagttttgcctaatgtaccagaagtcgctgtttttgatacgtcatttcaccaatcattagatccagttcaatacttatattctgttccttataagtattacgaaaagttccgtgctagaaaatatggtgcacacgggacttctgcacgctatgtatcacgtcgtaccgctgatcttttaaataaaccagttgaggacttgaagatggttctttgtcacttgggtagtggtgcatcagttactgctattaaagatggaaaatcttttgatacttcaatgggatttagtcctgttgcaggaatcacgatgagtacgagaagtggtgatgtagatccttctttacttcaatttattatgaaaaagggaaacatcactagttttaacgaagttatcaagatgttgaataccgaatctggtttattgggtctttcaggaatttcaccagatatgagagatattgaaaaagctatcaaaaatggtgataagcaggctcaacttacaaaagatatattcattaatcgaattgttcgttatattggtgcctacatgactgaaatgggcggattagatgttttagtctttacagcaggcattggggaacatgatgcaagtgtaagaaagcaaattatggatggtcttacttggcttggtcttgaatatgatgaagaagccaacaaagctaatcatgagagtgtgattactacaccaaattcaaaaattactgctatgattgttccaacaaatgaagaattaatgattgcacgtgatgttgttcgtttagcaaaattagataagttaaacaaataaggttaaaatcaaagttatagccttttaataaggactgtgatatcattgaaacatctggggatgttttgggattcgacaggcgtagattcgcgttgactgcgattcgtaggtcacgtctacgttaaaaacgtcacagttaaattataactgcaaataacgaaaattcttacgcagtagctgcttagtcagcctgcgtgatccaaagatggattgctcgtgtctatctacgggtcttaccatttaacgagctacgtttaactacttaccttaatagttagaaataagattcttaggttagttttgatagtttagccctgttatatggcgttttatcaaagcgaattttaagtaatataactatgatcgtagatgttaacgacgaaatacgtttggacaggggttcaattcccctcatctccatagtaaaaagcctgtaagttaaatacttacaggcttttttattatgtattaactgctatgtttaagattcaatagcagattctgttttgaaataaaactgataatcgtttaacattcagcactaataaaggattttcgctaaatctatacaattttttctaaattttatttatttttttataaaaagatgataggcttttagatgaaatgttaaacgcttaacatgtaggaggagaaaagatgttggaaaataaaaatcataaaaagatatctttaagcggaaaatctttgttaatgggaaccttgtcaacagcagcaattgtattaagtgcatcaactgcaaatgctgcgactattaatgcagacaatgttaatgaaaatcaaactgtagaagtaactgctagttcagtaaacaatgaaaataataagcaagtaactgaaaaagatagtgcagataaaagtactagtgatgtggctgaagatgctaacaccaagaaatcaaacgaaaatacagaaactacagaaaagaatactcaaacagttgttactaatgcgccagtaagtgatgtgaaaaatacaaacacagttaccgctgaaacacctgttgataaagtagtaaataatagtgatcaaaagacaactaatgctgcaactactgatactaaaaaagatgatgtaaaacaagttgaaaagaaagactcagtagataaaacaaatgctgaggaaaataaagatagttcagtaaagccagctgaaaatgctactaaggctgaattaaagggccaagttaaagatatcgttgaagaatctggtgttgatactagcaagttaactaatgatcaaattaatgaattaaataaaattaatttctccaaagaagcaaaaagtggtactcagttaacttacaacgactttaaaaaaattgctaaaactttaattgaacaagatgctcgttatgctattccattcttcaatgcaagtaaaattaaaaatatgcctgctgctaaaacacttgatgctcaaagtggaaaagtagaagatttggaaatttgggattcatggcctgttcaagatgcaaaaactggttacgtatctaactggaatggctaccaattagtgattggtatgatgggagttccaaacgtcaatgataaccacatttatcttctttacaacaagtatggtgataatgactttaatcattggaagaatgccggtcctattttcggtctaggtactccagttattcaacaatggtctggatcagcaactttaaataaagatggctcaattcaactttactacactaaggttgatactagtgataataatactaaccaccaaaaactcgctagtgcaactgtttacttaaatcttgaaaaagatcaagataagatttctattgctcatgttgacaacgaccatattgtctttgaaggtgatggttaccactaccaaacttatgaccaatggaaagaaactaacaagggtgctgacaatatcgcaatgcgtgatgcacacgtgattgatgatgataatggtaatcgttaccttgtgtttgaagcaagtactggaaccgaaaattatcaaggtgatgatcaaatttatcaatggttaaattacggcggtactaacaaggataatttaggtgatttcttccaaattttatctaactccgatattaaagatagagctaaatggtcaaacgctgcaattggtatcattaaattaaatgatgatgttaagaatccaagtgttgcaaaggtctacagcccacttattagtgcaccaatggtaagtgatgaaattgaacgccctgatgttgttaaattaggtaataagtattacttatttgctgctactagattaaaccgtggtagtaacgatgatgcttggatggcaactaacaaagcagttggtgataacgtagctatgattggttatgtttctgataacttaactcatggttatgttccattgaatgaatctggcgttgttttaactgcatctgtaccggctaactggcgtactgcaacttattcatactatgcagttccagtagaaggaagagatgatcaacttttaattacttcatacatcactaatcgtggtgaggttgctggaaagggtatgcatgcaacttgggcaccaagtttcttgttacaaattaatccagataacactactactgttttagctaaaatgactaaccaaggggattggatttgggatgatagtagtgaaaatccagatatgatgggtgtacttgaaaaagatgctccaaatagtgctgcccttcctggagaatggggaaaaccagttgattgggatttaattggtggatacaacttgaagccacaccaacctgtaactcctattccaaatgtaccaactactcctgaaaccccaaccacaccagataagccagaggtaccaactacccctgaagttccaaccactccagaaactccaactccagaagctccaaagaatccagttaagaaaactagtcagtctaaacttccaaaggctggagataaaaatagctttgcagcagttgttttaggtgctgtaagttcaatattaggtgctgttggtttaacaggtgtttcaaaacgtaaacgtaataattaaattaaaaaagatgagttccgttgaacttatctttttttgctataaatataatttatcctaggatgaaaaactgtaaattttctcaaaaatagcttttttctataatgagttagaaaagtaatagagtgctacctatctataggtcagaagtatatttaagtatgcttatcaaatattagacaattacttttcataatttagactagatgtttgaaagctttaataaaagaggaaatatatgcaagaaattaaagaaaaatattttgaaggagaaagagccctgtatggcctttcaaatacaattttaaaaaatgttacttttggtgaaggagaatctcctttaaaagaaaccaaagatttagaaataaaagccactatttttaaatataaatatcctttatggtattcaaataacattaatatcactgatgcgatttttgaaacaatgtctcgaagtggaatctggtataccaataatatttctattaaaaattctaatctgcaagctccaaagctatttagaagatgcaaaaatatcacattagaccatattttcttttccaatgcagaagagacaatgtggacctgtgaagatattgcaattaaaaatacagaaattaatggggattattttggaaaagatagctctaatatttacatggaaaatgttagagtaattggaaattacgtatttgatggagctaaaaatattgtatgtaagaactgtagttttgtttcaaaagatgctttttggaattgtgagaatgtaactttgattaattgtcagatagatggggaatatttgagctggaatagtagtcatattacgtttaaagattgtactattgagagtgatcagggactatgctacatggattatgttactttagaaaattgtatcttgaatcaaactcctttagcctttgaaaaatgtagtaatataaaagcaactataaacagcaaaattactagtattaaaaatccaatttcgggaataattaaggctaaaaagatagaaacggtaattattgatcctactaaagttgatcctaaggctacaaagattatttttatagaaccagttgatagagaagtatccgtttctgaccaaaatcaagaaggtgaataaatttgaaatatgattttaagacagtagtaaatcgaagacatacggattccgtaaaatggaatgtgcaagataatgaactgccaatgtccattgcagacatggattttaaaacagctcctgaaattattttggcaatgcaagaaaagcttaagcttggggtctttggctatgaagaagcgggagaggactattttaatgctgtaagcagttggtatcaactagagcatggagtcaatgctgatccaacatggatgatctttgtcactggagtagtaccagcaatttcatcaattgtcagacgcatatcgcatattggggataatgtattggtgcaagagccagtttataatattttttataattcgattgagaataatggtcgtcatgtattatcaagtgatttgagctatcatgatggaaaatatgagatcgattggcaagatttagaaaataaattagctgatccattgaccacattaatgctcttctgtaatcctcataatcctacaggaatagtgtggtcgcgtagtgaagtagagcgaatagcagctttatgccaaaaatatcatgtagtgttgttatcagatgaaatccacggtgacatagttagaaataatgtaaaatatacacctgcattttctgttacccaagaattgaaaaataatgtaatcagcctcgtatcaccaagtaaaacgtttaatgttgctgctcttcacgctgctacggtaattattcctgatgagaatttacgcatgattgttagtcgaggactaaatagtgatgaattggctgagccaaatctaatggcaattccggcaacaattgctgcttatacagaaggatttaattggctgcatgatttattagatacaattaatgagaattttatctatgctgaacatgaaataaataaaaacttgaaaaatgtaaagattgtctctggacctgcaacttacttaatgtggttagatgtaagcgaaatttcaaaagatagtaaaaaattagcagattatcttcgaaaagaaactggcttaattgtttcagctggcagtatttatcggggtaacgcgagtcaatttttacgtcttaatttggcctcaccaatatcgatggtagaggatggaattgaacgattgattactggaattaaaaatttttctaaaaaatagttgaaagtggtttcaaaattatctcaaaaagatatatacttttattgaggtgatttttttatggaaccattatttttaacgccatactttagaccaaaaatttggggtggtcgtaaattaaatactgttttaggatatgatattcctgatggaaaggttggagaagcctgggtaatttcaggatacaaagacgatgcttcaattgttaatgcaggtccatttaaaggaaagacattgcgagaagtatatttagagcatcctgagttatttggtaatccaaaagcaaaagaatttcctttactagttaaattcttagatgcaaatgataatttatcagttcaagttcatccagatgatgaatatgccagaattcatgaaaatgattcagggaaaacagaaagctggtacgtgcttcatgctgaaccaggtgctaaacttatctatgggcacaacgctaagagcaaggaagaactagaagattggattaaaaatggaaagtggtcaaagcttttacgctatgtacctgtaaaagaaggagactttttatacgttccttctggtactgtacatgctctaacaaagggtactatggttattgaaacccaacaatcaagtgatgtaacgtacagattatatgattgggatcgcgtagataagaagacgggaaagaagagagagttgcatattaagcaatctcttgatactattcaagtaccacataaagatccgaagctaaaaattacatcagaaacagtaggagatgctaagattactacgctagcacaaccaccgatgtcaccacatttttatttatggcagattgatgttgatggagattttgcttggagtttaaatgatcatccttatcttctagtatctttaattaaaggtagcggtaagtttattgctgatggtaaagagtatgacattaaattaggaagcaactttattattcctaacgaaatgaagaactttagttttagcggtaatttacgtttagtaatttcagctccgggtaaagaataaatttaagtgaatggagttggtcaaatgatttatattggttgcggggtaataatgtttgtaatcggggtcatttggctgattgctccttcgcccaaccctaatcgaatttatggatatatgtcctatttagcttcagttaatgaagcaagctaccagtatgcgcaaaaagtagcccgtaattattttatgttatttggtttgatccaaactcttttaggattaggaattcattttttgcattgggatcgctactttttaatttggttgcttactttttatttgtttatcttggctccaataatcttaactgaaaagaaattgcaggcttttttacgtgctcggcatgagttgccacatgattatattgaatcggataagattaaacatactagagtaaaaggatttaaggacaaataatgctaaagatattaatggttgaagatgacaattctgttgcggaaatgatgaaaatgttctttagtaaagagcagtgggacgtagatatagctaaagatggagtagaagctgttgaaatgtttaaggcaaatcccagctcttatgatatcgttacgctagatcttaatttacctaaaaaagatggtatggaagtagctaaggaaattagagcaatttctctctcaataccaataattatgttaacggctagagactcagaaactgatcaaattttaggattggggattggtgcagacgaatatgttactaagccctttagtcctttggccttaatagcacggatcaaggcgctatatcgcagaagccatctggaaaaggatatgcatgcttctaatggtataaaatatgatgtagtaactaagcatttaaaaatttcgaaggaccgtcgagaagtacgatttgatgataaagtggttgaaggtttgacccctaaggaatttgatttactttatactatggctcaaaagccaaagcaggttttttcaagagacaaacttttagagctagtgtggggatatgagtttttcggtgaggaaagaactgttgatgctcatattaaaaaattacgtcaaaaattagagaaagctggtcctcaagtagttcaaaccgtttggggtgtgggctacaagtttgatgattctgaggtatagaagttgaagttattctatcaagaaattttaggttttttgctagtaataattactagtattgtaattattggctcatcaactattcattttgcgactattcaagcctattctcaaagttacactcgcttagaagaatatggaacttcgattggaaaactagctttagcgaaagataatcctaaacatgaattagatgctaaatttttgaaaaatttacaggtagtaatggaaggcgaagatgtaaatcttcgcatttttaataataaaaatagacaagtttatccagaaactacaatgaactgggctttaccgcaaaagttatttaagcaattaaagaatggtaaaaagattcgcattagaaatgatcatgaggatggacgagtaagttctttttcaaataaagatgcatatactagtgtaattgttccctggcgtagtaaaggaaaactggtgggagtaatctggatcggttcacgtgtgcaaaatgtggaacaaatgattgtacgagaaaagcataatctgttaacagctttacttagttctttagttattggcgggttgatcagttttatcttgtcgtactatatttcaagaaagattaagcttttatctaatgctactaagaaagtcgcacaaggggactttaatgtccatctaaaacacaaggatactgatgagattgatgatttagcacgtaattttaatattatggttaatgctttaaaagaatcaaacgatgaaattaaggcacaagaaaagcgacgagagcaatttatggctgatgccgctcatgaaatgcgaactccgcttactacaattaacggtttgttagaagggtttgaatatgatgctattcctgaagaggccaaacctaagtctattgctttaatgcacagtgaaacaaaacgattaattagattagtaaatgaaaacttagattacgaaaaaattagaaataataaaattagtctgattcaatcaaaattcaatgcgactgaagttttagctaatttattaacacaaatgaagcaaaaagctgctcaaaagaatgatgagttgattttaaattgtccgcagcaagttgaagtttatgcagataaagaccgtttcactcagataatggttaatctagttcaaaatgcattacaatttactgaaaatggaaagattacaatttctgctaagaggattgagcatggcgcccaatttaaaatagccgatacaggaattggaatgaataagaaacagatgaaatacatttttgaaagattctataaggcagatccatcgagagcaaaaattggctcgggagaatctggcttaggactttcgattgttttatctcttattaaacagcatggcggtaagattaacgtcgattcagaacctggaaagggtgcaacgtttaccgtaaccttatatgataagggttataaggaatttattaaagactaacaaaaagggtagtacttaaaaatataagtactaccctttttctatttatcgagattatcttttcctggagaactgttttgattatttttatttttttcacttgtagctgattgaatattctcaggaatattattaatttcatccttatcgatttctgaagcatcagttgtataaagatcagtagtcgttcccttgtgctgagaataaagagaagtagatttgttacctaattcttttcttaattgcaacattttttgatagttaattttgtagtcgaattcgttcggattagttggaataaagccagctggagtgtagaaccgtagcagattatgattatttaacaaatcggaatagtgaagagaggtgcgtccatattcaactaatttagcaatttcaactttttgctttttattaaatttagtgatcttttccctagtttgatgattgtaaattgtccctttaatacctttaccgccaataattatatatttcggagtaacaatagtaccgtttctaaacacaactacttgtcgatattgtttggagaataaatcctgaccaaattgaatataatttttatttgaaattcctaaaagatgaagtaacgttgggagaacatcaatttcaccgctaagcttgttatcaattgtccccttaattccattcatatggatcatgaaaggactttttgaagttctgttgtgtcataagatgtccatttactaaaatctttacctaatactggtgccagagcagataattcatcatctgaactaccaacaccgtaatggtctccataaaggataaccatcgtatttttatcaaggccactcttttttagataatcaaagaactctttaactgattggtcaagataatgcgctgtctcaaagtaattattgatggttgtatttgaagtatttgtagtagtaaagttatcatctttatcttcttgatcaagttgaaatggaatatggttagtaacagttaaatacttaacatagaatggttgctgaatctgttcaagatacttaatgctttcactaaacaataacttatcttttaggccatatccgattttgtcgttatttttttgagagaaataatttgcatcgaagaaatagttatatcctaaatttttatatacttcatttcgattccaaaaagttcctgtgttaccgtgaaaaacagccgaagtatagccagtttgacgaagaatttgaggtgcaccttggaaagtattttcagatcctaatgatgaaaatagggaaccatctgaaataccatatgttccagtttcaagcatattttctgcatcactggttcgtcccaagcctacttgatgataaaagttactaaagctaacggtgtctttattatgatagagtgagttaagaaatggagtaaccttcttgtccattaacttttaatccaattagaaattgttgaaaactttctaggtgtaggacaatgacattttttcccttggctttaccaaaatattctggatttgcttttgcataatgctttttagtaaagtcgagtacttgattaatatcttctgcattagcatttttcttaacttggtttgattgtgcactttttaagaggtcatatactgaataagtatcaagtccaagatatttaaccacgtaagagcggtcgaatgtatttcttaataatcgtggacgtgaggtttcagctaaaaacatatttaaagttaacatgaaaacgccaaatgatgagacagcaaatggacgtttaaatccatacttacgtggatcaattttgataactttaataatcaataagataatgataattatgagatccagccaaagaaaaatatcgctgggatgcagtaaagcaaccgtactctttcctagtccttgtgatacttttccggtattttgaatagttttactagttaaaaagtctgaaaattgacgataataaatgacatttgcaaaaagcaaaatcgtatttattgtgtctaaaactagcattgcaatataagagactaatggcttagagaaatagagccctaaactaagaataataatgcatgtgcctaaaggcgttaaccagacgatgaagtgctggtatgggtcacttaagccaagcttaaaatcaaagtaagccgcatacatatattttgcccaaaaacaaagtgttaggattgttaagaaaccaattctagtttgccagaaattacgttttgttttattcacgcttcactactccttttaataaggaatattttactggtaatttcaaaaaacgacaaacttttgttaaaggtttgcgattttttaatattttgaaaaaaatcatctttcatggagatctttacgttataattaagccaaaattacggagtcggttaggttatgctttttttacaacccttatatgaatatatttttcaccattatgcagcgcatattaatcactttgccttaattaagttgattttgtatagcttagataagacacttttttactttattatttttgtaattattcgtttatgttggctgttattggtgagacatagaagaaccctgaagtccgaagcttgtgtatggatatttagtttttatataattttgctcttaatgctgacagtatttagagatacatattttccatggcagttgacatttaatttccatcgtagtctaagcgatataaacttagtatttatgaaagaaacgctgaaattgactcatggtcagagtttacttgactttttttataattcgcttggaaatgttttatggttcatcccgtttggttttttatttcctacagttattcagaaaaaaagtatggtgggaaccattttggccgggggatgtttatccgtaattattgaatctttgcaatttgttttagaaactggtgtaagcgatatagatgacgtattttttaatgtttgtgggactataattggatttatattatatcgaattatttatagattcttataagaaaaaactctagttttatgaggaagtaactgctaaaataaggtttgtatgtgaaaaagttacaaaaaaaggaagtttaaataatgagtaaagttgttcactttgatgcaagtaaattaactccttttgttcatgaaaatgaattaaaggaaatgcaagcaatggtaactgctgcagatcaagaattacgcgaaggtactggcgcaggtagtgacttccgtggttggattgatttgccaattaattatgataaagacgaatttgatcgtattaaaaaagcagctaaaaagattcaaaatgattcagaagttttagttggtattggtattggtggttcataccttggtgcccaagcttcaattgagttcttaaatagctctttctacggtagagaaaaagaaaagtacccaactgtagtattttgtggtaattctctttcaggttcatacctttacgatttgcttgaatggttaggagataaggacttttcaattaatattatttctaagtctggtactactactgaaccttcaattgctttccgtgtattgaaggataagttaatcaagaaatacggtaaagaagaagctgctaagagaatttacgcaactactgaccgtgctaagggtgctttgaagactgaagcagatgcagaaggttacgaagaattcgtagttccagatgatattggtggtcgtttctcagtattgtcagctgttggtttgcttccaattgctgtagctggtggtgacatcgatgctatgatgaagggtgctgcagatgcacgtgctgcttacactgatccagatgttttaaaggacagtccttaccaatatgcagcaatgcgtaatatcctttaccgtaaaggttacactactgaattacttgaaaactatgaaccatcattaagaatgtttggtgaatggtggaagcaattaatgggtgaatcagaaggtaaagatcaaaaaggtatttacccatctagtgctaacttcactactgaccttcactcacttggtcaatacatccaagaaggtcgtcgtaacttaatggaaacagttattcgtgttgaacacccaacacatgatgtaactattcctgacgataaggaaaacctagatcaattaaacttcttatcaggtaaaactatgaattacgtaaatgatcgtgcttacgaaggtgtagttctagctcatactgatggtggtgtaccagttatgactgttgatattgaaaatcaaacagctcatactttaggttacttaatctactggtttgaattagctgtaggtatctcaggctacttaaatggtattaacccatttaaccaaccaggtgttgaaagttacaagagaaacatgtttggtcttttaaacaaacctggttatgaagacttacatgatgatttaactaaacgcttaaaataaatctacttagcatatttttatagtatgcagatcgaatatagctagataatagttaaagaaagggtagaggctaattgcctccactcttttttattggagaaaaaatgaaaaaacagacagaaaatacattggctgtcctagcaacagcgttcatgtcctttgttggaattttaactgaaacaagtttaaatgtaacttttcctgcgatgatgaaacaatttaacgtatctttagatacaattcagtggactacaactggatatttattgatgattgcaataattatgattagttcttcttatcaaaatgagcgttttactgctaagcaattgtttgtaacagctgccattgcatttatggttggaagtattatttcagcatttgcattaaatttttatattttattgttagggcgtttaatttcagctctaggtgtgggtctctgtacaccaatgatgtttaatttgattgtagaagtaatgccaagagatgaatggggactatatatgggaattgctggtttagtagtagcaatggctccgactctcggtccagcttttgggggaagcatttcttattaccttaattggcgctggatttttataattgctacaattttcgcactattagtttttgttgctggaatttttgtgattggaagctaccatccagtaaaaaagaaatcttttaattggctggcttacgcaattttaagtgcagggatggtaagtttagtaatcggtgtaaatcaattgagtaagggactgaaaaattggcgtctatgggttttattaatattagccgcaattttattcatcctatttgtcagaatttctaaacgttctactagtaagctacttgacttatcagtttttgaagatagggcatttatttttggagcatgtgcttattttttacttcagtttattaatattggagtgagttttgtcttacctaactatatccaaatcgttaataaacaaacatctttaattgggggactcgttttacttccaggcagtattgttgctggactcctgaatccttattttggtcgactatatgaccgcctaggagcaaaagtgccattatatggtggcgcgtttttaatggcgctagggagctttttattagctaattggggcttaagcttaaccacatggatgattatttgtttttatggaattttgatgttaggacatcgtatgtcctttagcaatacgatggcgcaaagtttaaaaatagtcgataaaaatttgaaagcagatgcaacagctgtttgtcaaacagcacaacaattagctggttcaatggggactgcaattttggctgcaattatggcggtgtttcaaaataagcaaacagagagttatgctgctttaactgctcaaggaagtcgaatcgcattctatttcacttttggtcttggaattttgattttagtgtgtgattggtttatgtttagactagataaagaaaaacctacaagagaagaaagtgtaactaaagatgaataataattttttagctatggaaaaaaacatacacgattttgctcaagagctttattttagaaatgaagctgcaactgatttagtggaaaaagatgaacaaaaagacttattacattttgatagaagcggcgttgaagaattacaagagattgctggcattttgaaagatttttgtcagccacaagttcgagctattttagaagttagtgaagacgcaaagaaaaccgacctagatcagaacttattgcgggatcaatctcatcagttacttcaaaattatgctaacctagaaaagttagttgcttatgtagagaaacaagcagaacaaaaaaataagaaattgagtaagcaatgggtggagctaaaagaaaatctagctaaaatgaatattaatcaaatagaagatattgagaaaactacaaaaagtatgtcataaagagtgaaaataagtgatataattgaaaagctgcatcatggtgagtaagacgtgatgcagctttttttcactttaaattacttttcaaagaaaaatagcaatgtaacttgacagatttacaatattcaattatatttacatatgttgaatttgcccgttggtcaaatggttaagacgccaccctctcaaggtggagttacgagttcaattctcgtacgggtgatatactgagatatagccaaattggtaaggcacaggattctggttcctggatgtttcggttcgagcccgaatatctcaatacgttaccgtcagatcaatgatctgacggttttattttataatccaggtggtaaggatgatagaattttttaagactcaacatttggttgaaagtatggttagtgagcggattgttcctggagtaaattatgcctttattaaaaaaaagcaagtatttacctcaacagttggctttgctagtttaatacctaaagttgagcaacttagcccttttgctctgtatgacttagctagtttaactaaggtgttaggaacaactaatgtttttttgaagctgaaagaagaaggaaaacttaattttacagaacctcttaaagattttattcctgaatttaaagatgaacgtattcgccttagtgatttgttaacccatactagtggaattcggggatggattcctaatcgtgatgaattagctgcacctgatttattgaaggcgatcattgggttacctgttactgatgaatttaaaacaaaaatgcgatatgccgatactaattttattttattgggattagttcttgagaaaatctatgggctacctgtgcaagatatcattatgcaggaaatcattttacctgctaaattgaaagagacaacttttcatcctaaggcaagtgagtgcgttcctaccgctttaactgaaaagggaaaaatgttacgagggattgtacatgatcctaaagctcgggtattaggaaaagattgtgggtctgccggtttatttgcaaatctggaagatttaataaagataacccaggcttatttagggctacgtaatgacgttttacctctacagcaagataccttagctaatttgtttcaagttgaaactcctaagaaagtacatcctcgttcttggggatgggatttacggtttgatcctgttgaccaacacccattgatttaccatactggctttactggaacatttatgctaattgatcgacttaatcaaaccgcaatgattgttttaacaaatcgaatccatcctagcggacataatcatatttttcttgcaatgagggaaaagattgttgatacgtttttgaaagaaaatgtctgtaaaaattaaaaagggataatgtcaattgacattatcccttttatgttacatacctgctttaataattttcttttcacccattgttttacgaagtgaaagcatagcagtataagtggctaaaatataaactttcttagttggtaattttgaaatttcatctagcaaagcttcgttattagtagcagttgtcattaaccccggctcaaaacctgaaacttccagtctgaatcccatatcatgccaacgttttccaccgactattacttttttgatttgatctttgtttaaaccttcatagtctgcatcccagatccaggatgtatcgattccgtctgcgtgatttgcatttaaaagagtaactaaagaatagttatctttttcagtatttaacatatggagaacctcatcaagcccaactggatttttaactaagatgagatctatttccttatctgcataattaatcaattcttggcgaccaaaaattcgtttgttttcagcaaaactttgggctacttcttcttcacttaaaccaaattcacgcgctacagaataagcagctagagcattatagatattataggtaccaccgataccaatgctgtactctttttcacccattttgaattttaagctatttggagtttgatcaataatttgatttacactataggttaattctggacgatggtagccacaattaggacagaaatagtctcctaagtttgcataaatacgttcgtgataatgcaagatatgatcgcacttaggacataaaacaccatcagtatttacgggagccttgaagtcattttcaggcttgtcctccggaagtttgaagccatagaatacttttttattaggtaattccacggatgaaaaaatacttgcatctccgttagcgataatagttgcatcgggagctagtttaattccgtcgacaatcttttggtaggtagtataaatttcaccgtatctatccatctgatcacggaaaatattagttaaaacaaatacgcttggatgtagtaacttggttaccatttttacatttgcttcatctacttctagcacagcaattttcttttttgctcttttattcttgtgagctaaaaatgctgtaacaattccttgttgcatatttgagcctgatggattagttaaaatatcaccatatttcttctttaatgcttccacgattaaagcggttgtcattgttttaccattagttccagtaacaatgattgtctcatagccttttgctaatgaatttaatacttcaggatcaattttcatggcaaatttcccaggaaaactcgtcccgccctttaatacgttatgaagaaaccagtaagatgatttaccagctaccttagcgatgcctgattttaaattcatattattatccctcactttaaaactaaattttactatagcatatagagaaaatgaagacgacctttttatttttacctgcacgatttttaaatttactttatactaattaaggcaatattagtgaagttacataaacttaacaatggaggaattttgcagtggctcagttgttttttcgctatggtgcaatgagtagtggtaagtcgattgaaatactaaaggttgcccataattatgaggcacaaggacgaaaaattgctttaatgacgagtaatgtagacgatagaagtggagtaggaaccgtagcttctagaattggtttacatcgtaaagctgtacccataagtgaagatttagatttatttaattatgtttcagaattgaataaaagtgatgtggagtctggcaatggtagggtggcttgtgttttaattgacgaggcacagtttttaaaaagacaccacgtattagaatgtgccaaaattgttgatgaattaaaaatacctgtaatggcatttggtctgaaaaatgattttcaaaatcatttgtttgaaggtagcgaaaatttgttgatttttgctgataaagtagaagaaatgaagacaatttgtcactattgcggtcataaggctacaatgaatttacgaattaattctggaaaacctgtttatgagggtgaacaagttcaaattggcggagatgaatcttattatcccgtttgtcgttttcactattttcatcctaataagcaaagataaaagataagagaattaagaaaggataataattatggataaagtgatggcccaattggaaggattagttgcccattatgaagaacttcaagaaatgatggctgatcccgaagttattaacgatactaagcggtatatggaaatctctaaagaagaagccgatatgcgtgaagtagtacaaaaatatcgcaaatataagtcagatattaaagaaattgatgataataaagaaattatttctactgaatctgataatgacttagttgagatggcgaaggaagaaaattctgaattagaaaaagaagttgctgaattagaagatgagattaagatcttaatgcttcctaaagaccctaacgacgataaagatattattatggaaattagaggagctgccggtggggatgaagcatcattatttgcaggtgatcttcttagaatgtacgaaaaatacgcagaaactcaaggttggaaagtatctttaattgattctgagccgactgaagtaggcggatataagcgcgttgccgttatgatcacaggtgataaagtttactcaaaattaaagtatgaaaacggagctcatcgtgtacaacgtgttccagtaactgaatctcaaggtcgtgttcatacttctactgcgactgtagccgttatgcctgaatacgaacaagtagacatcgacttagatccaaaagatattcgtgtagatgtttaccgttcatctggtgctggtggacagcatattaacaaaacttctagtgccgtacgtatgacacaccttcctactggtattgtagttgctatgcaggatcaacgtagtcaacaacaaaaccgtgaaaaggctatgcaaattttgaaatcacgtgtttatgactactatgaaagtcaaaatcgtgatcaatatgacgctaaaagaaaagaatctgttggtacaggagatcggtctgaaagaattagaacctataactatcctcaaaaccgtgtaactgatcacagaattggtctaactttaaacaagcttgatcgaataatgaacggcgagttggatgaaattattaatgcactcgttctttactaccaaactcagcaattagaaaagatggctgaagaaaatgcctaaaagtctaaaaaaaataaaagaaactgtgttaaatgataattctgaaattcgtccagaggatattgattacgttctgggagaaagattaggctatacaccttcagaatttgaattacacattaatgatgaattaactccggaacaagaaaagcaagcattaaaagatatgaaaaaattgcgtcgaggaatttctccgcaatatattttgggatacgcttggttttatggctacaaaattttagttaaccgtggagttttaattcctcggtttgaaactgaagagttagttaaatgggcacttgaaaatattgaatctggtaaaaagatccttgatttaggaactggttctggagctattatggttgccttggtaaagcaagctcagaaacaggggattcagaatttgaatctatacgcaagtgatattacagattccgctttacgtgaaagcgaagaaaatttcttaaagtatgatttagatgttaaaacccgtaaggcaaatgtattagtgggcttagaaaaattcgacatgattatttctaatccaccctatattaagactagtgaaaagaacttaatggataaaaatgttataaaaaacgaacctgatactgccttatatgggggagaagatggtctagatttttatcgtaaatttgcaaagcaagttcagtcacatttaaatcctcaaggacaatttttcttagagttcggttttagtgaaaaagagcaattaaaagaattatttgagactgaattaccagattttgaaattgaatttaaggatgacttagcaggtaagccaagaatggttcatggaaggtggaggaagtaatggaaacgaagattttcaataaagaacaaattcctgaagcagttgccctgttgagaaaaggagaattagtagcttttccaactgaaaccgtatatgggcttggggcattagcaactaatgaaaaggctgttaagagtgtatatgcagctaaaggccgcccaagtgataatccattaattgtaactgtgtctgatgaacaaatgatggaaaactatgttagtgaagtaccagaacgtgctaaaaagctaattaagcacttttggcctggtccattaactattattctttttgtcaaagaggggactttgccagatgctgtaactggtggtctcccaaccgcagcatttcgctgtccaaatgatgacatgactcatgatttaattagcggactaggaaaaccaattgttggtccatctgctaatacttccactaagcctagtccaacaactgcagaacatgtttttcatgatttaaagggaaaaatagcggggattattgataatggtccaaccgagattggtttagaatcaacaattgttgatttgtccgttgaaaagccaacagttcttcgtcctggagaaattacgcctgaagagatttcagcagttctaggagaagaagttttgatgaataggggaactacgcagactaagggtgtgccaaaggctcctggtatgaaatatcgtcattacgctcctagtgctcctgttttaattgttgataaagaagaagatttttcgaaaatccaatgggatgatgagactggtgtagctgctttggatgaagttcttgaaaagatcgatagtcctaataaatatagtctaggcaagaccattgataaggcagctcataatttgtttggtgctttaagatattttgatggtgaagataagattaagcgcatttatgtccaaggttttgaccatggtgcaattagtgctgcttacatgaatcgtttaaacaaagctgctgctggccaccattttcattaaaaataaaaaggcatgtagaaaaacatgccttttttcgtatgatttaggaaacatttatctaataatttgttaaaataatgaacgaagtattatttttaaaataggaggccattatgggtaagtttactgttttgaatcacccgttgatccaacataagttgacaatcattcgtaagaaagatacaggtacaaatgaatttcgtcaaattgttggtgaaatcggtggactcatggtttatgaaatgacacgcgatttgccattgaagaatgttgagattgaaactccaattggaaagtcaactcaaaaagaattagcaggtaagaaactagttatagtaccaattttacgtgctggtcttggaatggttgatggtgttcttcaaatgatcccatctgcaaaagtaggacatatcggaatgtatcgtgatgaagaaactctaaagccgcatgaatatttcttcaagatgccaccagatattgaagaacgtgaatgtattattgttgatccaatgcttgcaacaggtggttcagcaaatatggctattgaagcattaaagaagcgtggcgctaagaatattcgtttagctgttttagtggctgctcctgaaggtgtaaaggctgtacaagaagcaaatccagatgtagacatctatgcagcagcagaagatgaaaaattaatggataacggttacatctacccaggtctaggggatgcagggggatagattgttcggaactaagtaattttactcaaaaatattttgaaattgaaatttttgggtgttatcatttttagtgtgtttgaggtattcagcacaagaagggaggtcacgaagtgaatgagaaatctgtagtcgttaatgtattcggcttaaatttcaatgtaactaactgcttagggggaacgttagtcgcaattgcggttttctttcttgtttggtatttaggacgtaatgtttctttaaaacctaataaaaagcaaaatcttttggaatatatgattgattttacaaatgggattgttaaggataacgttgcggacgtagatgcacaaaagcacctatctttatatgcctttaccctattcatgttcattttctttatgaaccagttaggtttgttctttgagttttcaattaatgaccatatccttgtcaaatcaccaactgctaacccattaattactatgaccatggcaatgatgacattgcttttgtcttataactttggtgttcagaggtttggtgctaaaggttattttgcaaattatgcaaaaccagttggatttttacttccaatcaatattattgaggaattcactaatttcttgacgttatcactacgtctttacggtaatatttatgccggtgaagtattattaactttaatcggtaatcgttttgcaaagagtgcgggttggtttaccgtcatcgcttcggttccactaactttaatctggcaaggcttctctgtctttattggctctatccaggcatatgtattcgtaactttgtcaatggtatatattggtaaaaaggttactgaagaataattttacggaggtttttctatgaaatatttagctgccgcaattgccgctggtttagctgctttggctgcttcctacggtaacggaaaagttatttcaaaaactattgaaggtatggcaagacaacctgaatctgctaacaaccttagagcaactatgtttatcggtgttggtttgatcgaagctgttcctatcttagctatcgttattggcttcttaattctcttcctgtaatttgcgttttaagaacaagatcgtagttacgagaaagaagggttgagacatgcaatttatgtttgcagccttaaaattagagttaggtgacacgctttactatcttttgatctttgcagctttgctcctcttagttaagcactttgcttggggccctgtaacaaagatgatggaagaacgtcgtcaaaaggtaataagcgaccttgatcaagcagaaagtgatcgaaagaaagctgaattgcttgctaatcaacgtgaagctgccttgaaagactctaaacaagaggcaacacaaattctttctactgcaaaaagcaatgcggaaaaaactaagaataatattattagtcaagctgatcaagaagctgccgcaattagaaagagagcatcagaagatgctgcccaagcaaaaactgatgcactcaatgaggcaagagatcaagtagctgatatttctgttgctattgctgaaaaagtaattagcaagaatttatctgctgctgatcagaaagacttggtagatcaatttatcaaggggctgaatgactaatggctttaagtagagaagaaattgcttccagatacagtaaagctttatttgcttatgcacaggatgctaatagtctggatgcagtccatgaagatatgaatgtattgcttcaagtagctaaagaaaatcctgatatgctgcgtttgttaagcgatccaattattcgaaagaatcaaaaagaagaattcttatccagttttagcgataagttttcaagtgaaactaagaattttttggatttcttattagaatatcgcagatttgaatctttaactgcaattattgaggcatttaatactctttatgatgaatataagaatattgcttctggtactgcagtaagtgctattaagcttaatgaagatgaattaagtcgaataagccaagcctatgctaaaaagtatggctttaaagaattgattctaacaaataaagttgatccaagtatcttaggaggtattatcctcaaagtcggggatcgcattattgatggttctataagaactcgattgcaacaaattcgtgagcaattaattgaaaatagataaaagaggtgaaaccattgagcattaaagcggaagaaattagcgctttgatcaagcaacaacttgagaaatatgatgataagctcaacgtcaacgaagttggtactgttacctacgtcggtgacggtatcgcccgtgctcacggtctaaataacgtattatcaagtgaattattacaattttctaatggttcatacggtattgcgcaaaacctagaagccaatgatgttggtatcatcatcttaggtcgctttgacgatattcgtgaaggtgatcaagttaagcgtactggtcgaattatggaagttcctgttggcgatcaattaattggtcgtgttgtgaacccattaggacaaccagtagatggtttaggtgagattaagactgataagactagacctattgaaagtaaagctcctggagttatggatagacaatccgttaaccagcctttacaaactggtattaaagctatcgatgctttagttccaattggtcgtggacagcgtgaattaattattggtgaccgtaagacaggtaaaactgctcttgcactagatacaatcattaatcaaaagggccaagatgttatttgtatttacgttgccattggtcaaaaggaatcaacagttaaaaactctgttgaaactttaaaacgatttggtgctatggactacactattgtagtagaagccggtcctagtgaaccagcaccaatgctttatatcgctccatatgcaggaactgcaatgggtgaagagtttatgtacaatggtaaggatgtattaatcgtatttgatgacttgagtaagcaagccgttgcataccgtgaaatttccttacttcttcgtcgtccacctggtcgtgaagcttatccaggtgatgttttctacttacactctcgtttactagaacgtagtgctaagttgaataagaaacttggtggcggttcaatgactgccttaccatttattcaaacccaagctggggatatttcagcttatattccaactaacgttatttccattactgatggacagattttcttggaagctgatctattctttgctggtacacgtcctgccattaatgccggtgaatcagtttcccgtgttggtggtagcgcacaaatcaaggctatgaaaaaggttgcaggtacattgcgtgtggacttggcatcatatagagagcttgaaagttttgctcaatttggtagtgatcttgatcaagctactcaagctaagttaaatcgtggacgtcgtactgttgaagtattgaagcagccactacataagccacttcctgttgaagatgaagtattaattctttatgctttgacacatggctttttggatgcaattcctgtacctgatattcaacgttatgaacttgaattatatgattactttgcaagtaactataacgacttacttgatgtaatccgtactacaggagatttacctgaggaagataagcttaatgaagctttaaagaacttcaacgaaggtttttcaatcagtaagaaatagaagaggaggttttttcattggcagaatctctccttgaactgaaaaaaaagattgcttcaattcagaaaacaggtcaaataactgaagctatgagaatggtttcaggggttaaattgaatagaactgaaaaacttgatcaagaatatactatttataacgataaagttagagcaaccgtttctcatctgatgagttcacaaattgtgaatcaattaggtaaagagacaaatgaatatagtgaatttagcggtcaatctaatattgattatagtagtttcttcgatttaggtactttagcatctttagttcaacctcgtaaagaaatcaaatcgactggttacttagtaattagtggagatagaggtttagttggttcttataacagtcaagttattaagaatatgatgagtatctttaaagatgctgatgcccaaaataaagatgttaaaattttggcagttggtagcgttgcagcacaattctttaagaagcaaaatcttaatgtggtatatgaatatagtggggtaagcgatgtcccaacttacaatgaagttagagatattgttcaaaccgctgtaaagatgtacttaaatggcgtttatgatgaactttttgtttgttatactcaccacgtaaatacgttgacttctgcttttagagtagaaagcatgttaccaatttctgatattgatattaatcataaagaaacaatgccaaaagactacattattgagccagatattgattcagtattgaagacagttttacctcaatttgctaaatcaatgatctttggagctattttggatgctaaaactgctgagcatgcaagttcaatgacagcgatgcagagtgcatctcaaaatgcagatgatgttgtttctggtttgaagactaaattgaatcgagcaagacaggcacaaattactaccgaaattactgaaattatcggtggtgcaaatgccttagaataaaatagaaaaggaggtagatgttttgagtaaaggcgaaattgtccaagttattggacctgtcgttgacgtggaattcccactagataaagatttgcctgatattaataacgccttacgtgtcacaaacaacaatggtgatactcttgttcttgaagttacactagaacttggtgacggtgttttaagaactatctcaatggaatctaccgacggtttaagacgtggtatggaagttgaagacacaggtgctccaatttctgttcctgttggtaaagacactttaggacgtgtctttaacgtattaggtgatccaattgatggtggtcctgctctaggtaaagatgtaaaacgtgaaggtattcataaagaagcacctaagtacgatgaactaagcacaagtgaagaaattctagaaactggtattaaagttattgacttacttgaaccatatgttcgtggtggtaaggttggtctattcggtggtgccggtgttggtaagacaactattattcaggaattgattcataatattgcccaagaacacggtggtatttctgtatttactggtgttggggaaagaacacgtgaaggtaacgacctttactttgaaatgaaggcatctggcgttttatctaaaactgctatggtctttggtcagatgaatgagccacctggtgccagaatgcgtgttgcattaactggtttgactattgcggaatacttccgtgatgttgaaggtttggacgtattattatttattgataatattttccgtttcactcaggcaggttctgaagtttctgctttacttggtcgtatgccaagtgccgttggttaccaaccaactttggcaactgaaatgggtcaattgcaagaacggattacttctactaagaagggatctattacttcaattcaagccgtttatgtgccagctgatgactatactgacccggctcccgcaactacattcgctcacctagatgctactactaacctagaacgtcgtttggttgaacaaggtatttacccagctgttgatccacttgaatcaacttctagtgccttagatccagaaattgttggtgaagaacactatgaagtagctgttaaggttcaacatattttgcaacgttaccaagaattgcaagatattatttctgttttaggtatggatgaattatcagatgatgagaagttaattgttgaacgcgcaagaaagattcaattcttcctttcacaaaacttctttgttgctgaacaatttactggtattccaggttcatatgtaccaatcaaggaaacaattaaaggcttcaagatgatcattgatggtaaattagatgatcttccagaagatgctttccgtaacgttggtccaattgaggatgttattaagcaagctgaaaagatgggagttactcctaaaaatcctgaagcaaaagcaatactagaagcaaagtagggtgatgcgttatggcagatccagaaaaaattataaaagttagcgttgtaacacctgatggtattgtctattcgcataatgctacgatggtagcaatgcgcgcaattgatggagatcgtgcaattatgtatgatcaccttccaattgttactcctttagctattggtgaagttcgggtaaaaagaacgcatgaaatgaatgatcgtattgaccatattgctgttaatgggggctatattgaattttcaaataatgaagcaaccattattgctgacagtgctgaacgggctcgcaatattgatgttaaacgtgcacaatcagctaagaagcgtgctgaacaacatatgcaagaagctaaagagaagcacaacgaaagagaaatgctagaagctgaaattgctttacgtcgtgcggttaatagattacatgtacgtgaaaattacggtaaatagaaatgagaaagacgaacgatgagttcgtctttttttatggagaaaattatatgatgaaacaagtaggagttcatgcaattgttagtctaatcacatatttagtgacgattgcattttcgttcagagcagtgagaggtctgagagtggaccagttatttaaaaagggacacacatttgaaattcaagtatttttactatttgtgtcgattgccttagggtttatagtcggacaatttattttggcattagtggatcaatccttagctttaaaaatgcttttttaatgatttttataagaaatgcttttgaaaagcacttctttacacttgtccttaaagtaaagcggtatttatgttacaatttttaatgattaaatactggaggcactagcgtggcaagagatataggaattgatttaggaactgcaaatgttctaataaatgtatctggcaaaggtatcgttttaaatgaaccttctgttgttgctgtagatactgataaagataaagttgtcgcagtcggtactgaggcatataaaatggtagggcgtacaccaggtaatattagagtaattagaccattgaaaaatggtgtaattgcagattttgatattacagaagaaatgcttagctactttattgaaaaattaaacgtaaaaggttttatgtctaaacctaatattctaatctgtgctcctactggagttacttcaattgagcaaaaagctattattcaagctgctgagaaatcaggtggaggccgagtatatctagactttgaacctaaagtagcagctgtgggagcagggctagatatttttagaccacaaggaaatatggttattgatattggtggtggtactactgatattgctgtcttgtcaatgggagaaatcgtaacttcccgctcacttcgttgggccggggataaaatgaatcaggccattgccagctatattaaacgtagtaagaatcttttagtaggacaacacactgctgagcaaattaagattcaacttgggaccgcttttgaagcggatccaactaagacgatgactgttcgtggtcgtgatatggttgacggattgccaaagcaagttacaattaacgagctagaagttcaaaaggctcttgaagatggtttaatgtcaattgtggctgcaactaaagaagttttggagcaaactccacctgaattgtctgctgacattatcgatcgtggtattatgttaacaggtggtggagccttactaaagaatattgataaattaattacttattatctccaagttccagttttaaaggctgatgaaccattagaagctgttgcaaatggaacaggtgtgttgcttaaaaatattgaaaatcatcagagacactaattatgaagagagcaagttttaatttttcattagtaaataaacatttaaaaaaattgggaaagattattttatacttgtttgcaaccatgctccttggagcctttattggatgtggtgttgcaagtggcaatccttttgcaattttctttcctacaacatggattcatttttttgagtttttaagttaaaatgaataaattgttaattgggttggtaaatgtttataagaaatttatttctccaattttgccaccaacatgtaggtattatcctacttgttcaagctatatgattgatgctttaaaaaagcatggagcaattttaggcttaataatgggactagcgcggatattacgctgtaatccttttattaagggaggagtagatccagtaccggattattttaccctgcgtcgtaatcctcatcctgaacgatatgaagatgaaattattgcgcaggcatttcattcgaataaaaagtaggagaatatatatgtctagaaaattggaaagtattgatattgaagttaatgaaagaaaaggcacttcagcacctacctgggaagttgttattcctggcaaacgttctattggaattattgaacaagaagaagaacgctaccatgtagtatcttccaaaacaaatcacagtctctattccaagactttagaaagtgctattaatgaattactttcatactttactttgcatgagaaataaacaaagtagggatatacaatgacaaaagttgaaaataaagcagattggtatgatcgcatcgcatggggtgtagtaattccagtctttttattagccgtcatcagtctatacggtatttgggtcgcaactgtgaatgatcctaaaatgggtagtccagtaaaagcagttattactcaagcagtttggtatctggtatcaattgcactggtgattttcgtaatgcaatttgatgcagaacaactttttaaaattgctccaattgcttatgggattggaataattttattaattgcagttttattcttgtataaccggcaagtatttgccgataccggtgcgaagagttggtttaaattaggaccattaacttttcaaccctctgaaattatgaaacctgcctttatcttaatgttagcgagagtagtagagcggcataatgaacagtatgcccatacttttaaaacagattggcttttgattggtaaaatatttgcatggttaattccagttgcagttttgttaaagctacaaaatgacttcggtaccatgcttgtgttctttgcaattgttggtggggtaattttagtttcaggaattacttggaaaattatcatcccagtatatggtgttgtgtttattattggtgcagcagcaatcttactggttactacccccggtggacaagcatttttaggaagtgcatttaactttagggcctaccagtttcaaagaattaactcttggttgaatccatctcaagatacttcgtcaggtgcttatcaattgtggcaaagtatgaaggcggttggatcaggtcaaatctggggacatggttttggtaaagttagtgtttatgttcctgttagaacttccgatatggttttctcagttattggagaatcattaggttttgtaggatgttgtgctttgattttgatttatttctatttaatttttcaaatggtcaaaattacttttgaaacaaaaaatgcattttactcttatatttctacaggaattatcatgatgattttattccacgtttttgaaaatatcggaatgggaattgatcttttaccattgactggtatcccgctaccatttgtatctcaagggggatcagccttattaggaaatatgattggaattggcttgattctatcgatgaagtggcaccataaagattatatttttagtaccgctggagacttttaaaagtataaaaaaatacctcatcatttttgatgaggtatttttttgctcttaattttttctatttttcttaatatcttcgttttgtgcagctggttgacgaattacaagaacatcacaagctgcagtacgggtaacatactccgtaatactaccaattagtaatctttctacggcgtttaaacccgtagcacctaaaattattaaatcgatattgtgttcttctggaaactcatgagcaatgatattctttggagaaccaaattcaattgaatagtgaacatctttaactccagcatctttagcccggttataatattcttcaattttggtttttgcctcttcagatacttgttcaaccattgctgaatcaaagctagaaacatcttgaaatgcacgagtatctactacgtgtaaaatttcaagagtagcaccgtttcttttagctacttcaacagctttgctaaatgcaacgtcagcttcttttgaaccatctacggcaacttggatatgttggtattgttttaacatgttgatcacctctccatcaatattttaccaaaatttgatttaaatagaataataataaaactattcatttaaattcatgaaagtaaatgaaaagatggaaagcgccattgcagcaataattaaggtaatgaaattaaatattttaggtaaggtaaataaaataataatcccaataaaaccagttaaaattaacactaaactagtaattgagaacagcatattaattttcttatttccgataaaagtgaaaataatgaattgtcctttatttttacttctaattaaataccaagctgtaataaacactaataaaataaaaattagcattagaacttttaataccacttattaaacctcacttaataaaaaaagcggcttacgccgcttccttgaatttcaataaaatctgagttgactgcaacataatgacgcttgttgaacccgcagtgttcaaaatttgaatctatgtcgcagtgaatatggatcctaggacaagctagtattccgattcagatgttattcataaattccaacgtctttagtttgatcggtcaactttgtaattaggttgatcaactcagatcactatctattctagcaaagatatgattaatgtcaataaattggatttacttttgcagcccgtctttttgcattttttttaggcgcagatattgtctttttaatgcatcttcaactttagaattacccttcggattaaagtaggagacattttttaggttgttaggtaagtattgctgggcaatccaatcaccttgaaagtcatggggataaagataagaaacaccatgatttaaggtagccgctcccttgtagtgtgcgtcctttagactatcagggataggatcattctgcttatttcgaatgtcacctattgcggcatcaattgcagtaattgcactattacttttgggcgataagcagagttcaatgacagcatttgacaaaataattcgcgcttctggtagacctaccatttgagcggcttgtactgcattaactgcacgactgcaggctgggggattagcgagtccaatatcttcataggcaattaccaataatcgtctacagattgctactaaatcgccagattcgcagagattccctagataataaagtgctgcatctgtgtcagaaccccgaattgatttttgaaaggcagataataaatcgtagtggccatcaccatttgcatcataattttgagatttaaattggatggaatcttgcatttcagctttatcaattactagtttattatcagcgttctcctgtttttcttcttttgttgatagaactgctaattctaatgcattaaggattgctcttaaatcgccatttcctttttcaatgaggagattacgcgcatcttttgttaactctacattgtatttacctaatcctgtttcggaatctttaagagcacgatcaatcgcgtgcgaaatatccatttctttaagacgatgtaattcaaaaatctgacatctggatcgaatagcgggagagatggaaatatagggattttctgtcgtagcaccgattaaaataatattccctgattctaaaagaggtaatagaaagtcttgctttgttttgtctaaacgatgtatttcatctaaaagtaagatgacagttccactcatttttccttcttcagcaacgatttgaagatctttttttgtgtcagttgctgcattaagttttctaaatgcatatttagtggaacctgcgattgcgctggcaatactagtttttccaataccaggaggtccataaagaatcattgaagatagaagtttagcttcgaccattcgtctaattattttcttatttcctactaaatgttcttgaccaacaacttcatctaagtttttggggcgcatacgataagcaagaggttgcataattagtccttttttctaaataatttgtcccagaaattttctttttttggttttgataattgttcatgtggcacttctggagcatatacttggttgatgtcaattcgataatgattaatagcagtttttgaaactactaaaacgccagtggagtctggttcgtttttggcagtttcgtcatttattaaagtgaacttaatatctttttgtgaacacaaactcattaatttactaataaatttattttgaggcattttaccattgattaagatagtataatttttaaagtcatttaaatggtctaaaaacaaagtatctaaggccgggttatcggtttcttttacagtcattcttactagaactcgttcacgtaaagaacctaaatatcttctccgttcatcgggacaagtttgaggagtaatacctttagcagcatgttcaagacgtgtatttaaatcttcagtcatatttctttttcctttttataataaaatattacattcttagtgtagcaagtggaaaagaagaaaacaaaaaagtctttccaaaagaggaaagactttttgtaatgaagcagtaagtattaaagcttcttgttgtaccattcaacgataagagcttcatcaacttctggttccatttcgtcacgttctggaagacgaactaaagtaccagtcatcttgctgtcgtcaaatgaaacaaatggtggacgtgatacaactgcatctaaagcgtccttaacttgttgcaagttctttgacttatctcttaagctgatttcttgaccaactttaacttcgtatgaaggaatgtcaacacgcttgccatctactaagatgtgaccgtggttaacaagttgtctagcttgttctctagttgaagctaaacctaagcggtaaacgatgttgtctaaacgtctttcaagtaaagccataaagttaacaccgtgcttaccttcacgaatcttgccggcacggatgaataagttttggaattgacgttcatttaaaccaaacatccaacgtaacttttgcttttcttttaattgttgaccatattcagaaacctttgcacggttgttaggaccatgatcaccaggtgcgtagttacgacggctaatttccttaccagtacctgaaagtgagatacctaagcgtcttgaacgtttccaacttggaccagtatatcttgacataaaaaatcctccataaaaaataataattttttggagtaaaatatgagaaataagttcaacattcgtgcatctcaagttgcatgtttcgcccagtgcagcgcgggttactcgttcactaaacgcctcaagatgttgacgttcttgtcacttattgctgcaaatattttacacgaagactattatagtaagaaatatgttttaaagcaagtaaaagtagagattttctagctggtattaagatgaagtctggtataattaatatgaaatatggagggtattatgtcatcagggttatctattcttattattgtaatattgattgctataattgctgttattgctacagttgttattcttaataagtattttaatcatcagattgcggaattagatgcgctaactgatgaattgaaagatattagcgttgaagaagatattaaacgtttagagaaaatggaattagccggaaaaagtttggaaacttttaaaagatggcagaaagtataccagaaggttgatactaaggacgttggagaattaaagcatcttcttgaacaagcggctgggcttaatgcaaaatttaatttaataaaaactcgccaattaattaaagaagcaacagaattattacagactaatcaagataatgtagaacacagtaagcaagtatttactaatttactcgaagcaaatcgagataatcaaaagcactatgctgctttatcaaaagactaccaacaactacgtaaaaaaatattatcccaatcttttaattatgggaatgcaattgatcagattgaagaagatctggcgactttagaaagtgattttcaaactgtaaagaatttatctggtgaaggagatcatgaagaagcaaagaaagtattagttaaaattgatacacagcttaccactttaaaaactgatcttcctaagatagagaactttgatcaagagttgaaaaatgtttttcccgaccaacttaacgaactcagcaatacttaccgtcaaatgataaaagataagtacaaaattactgaagtggatgtactagaagaaatcaagagcttaagagaactagttgatagtactaaaaagagtcttaccaaattagagcttaaaaaggttgaaaagaataataaagaaataagtacacgaattgatagcttatatgacattcttacaaaagaatttaaagctcggccatttgttgataaaaatcaagataaaattgttcaaattctttcccatgttggaaatgcatctaatcaacttgtagctaagttagagcatgtggatcaaagttatgaattgacacatggagagctagctgaagctagacaactaaaaagtcaagttagccgaatgaattctgactttgatgttgactgtcaaaaactagctgatggcaacggtgtttattctcaaattgagaataagtggctaaccatgttagataatttaaaagaaattgaaaagactgagaaaaaactctcaaatgatatagatggactatttgatgcagaaaaaattgctaatgattctataattcattttaagcaagaaatttctttagtttatcgaaaagttgaacgacgtcagttaccaggaaagcctgaaagtttcattcaaatgtatactttagtcttaaatgaagttaagcatacagataatgaattgaatcaagttagaataaatatggaaaaaatatctagtgaactgattcagattcaagaagatattgaacgtttaaagaaagaagcagatgagattttaaattctgctgatttagttgaattgactatgcaatattcaaataaatatctttcaaatcctgaaattaaacgcgcacgtaaagaagcttatgatttatatcagaataaatatgagtataaagaagcgttggacgtaattgcgacagcgctagaaaaggtagagccaggaagctatcaaagaattgaaaaagaatactatagcgagcaagaagcagacgaagaagagtaaaagattgaagcaatagtatttttaagttaagattttatatgattatcaaacgaccatcttctatggtcgttttttaggggagaaagaaaattgatctattttgataatagtgctacaacagctgtctatcctgcagctttagagacatatgataaagtaacaaaggatatctggggaaatccttcaagtttgcataaaatgggagatcgatctcatcaacttttagaagcttctagaaaacaaattgctaatttattgaatgttaagccatatgagatatttttcacatctagtggaagtgaatctgataattgggcaatcaaaggtactgctttagctaaaaaagaatttggtaaccatattattacatcaagtgttgaacatgcagcagtttcaaattcagtacgtgctttagaaaatttgggatttcgtataactgttttaccagttgataagagtggacaagtaaatcctgaagatttaaaagaagcattagataaagaaacaattttggtttcaattatgggcgttaataatgagattggtacaattcaacctattaaagctattagtaaagttttagaagattatcctaacgttacttttcatgttgataatgttcaagctttgggaaaagatgtttgggatgaggtatttactgatcgagtagacctaatgagtctatcagctcataaatttcatgcacctcgtggcgtaggtattctttataaaaaagaaggtaaaatgattaagccgttaattgatggcggtggtcaagaaaaggccctacgttcaagtactgaaaatttacctgcaattgcggcaactgctaaagccatgcgtttatatttagctgatgaaaagaaaaatgctgagcaagaattggcagttaagaataaaatagtttcctatctaaatggaaaaccaggaattcatattttttcaccaattaacgataattttgttccaagtattttatgtttttcattagaaggtattcgcggggaaactttagttcatacgcttgagtctgaagatatctatgtttcaaccactagtgcatgttcttcaagaagtggtgtagagagtggcactttgaattctatgaaggtagatgatgatttagctaccggtgcaattagactaagttttgatccaagtaatacaattgaagaagctgagcaatttatttcagtttttgataaaatatataagcacttcgctgaaattaatcatttgaaataaggtgaaattatgcaatatacagaagtaatggttcgctatggtgaactatccactaagggaaaaaatcgaaaagattttattgggagacttgctggtaatgtaactagagctttgcaagattttccagaaattgagatccatcctaaacatgatcgtatgcatattgtcttaaatggtgcaccatttgagacaattgatcaacgtttaaaacttgtttttggtattcaaacatattctccaactataaaagttgataagaatcttgatgcaatcaaaaaagcatcccttgaattgatgcaagcaacttttaaagatggtatgacatttaaagttaatactagacgcagtgaccatgattttgaatatgacactaatcagttaaacatgatgattggtgattacctatttgataatatggataatttaaaggttcaaatgaaaaagcctgacctagtcttaagaattgaagttcgtcaagacgcaatctatatttcaaaccaacttcttcatggagcaggtggtatgccggttggaactgctggaaaggccgtcatgatgctatcaggtgggattgattctccagtagcttcttacttagcaatgaagcgtggagttgaaattgatatggtgcacttctttagtcctccatatactactgaaaaggcacttgctaaagcaaaagagttaactggaattttggctaactattctggaaagattaactttattgctgtaccttttactgaaattcaagagcaaattaaggaaaagttaccagaaggttacttaatgaccattcaacgccgctttatgttgcaattagcagatcgtattcgtgcaatgcggggtgggttagcaatcttcaacggtgaatcagttggtcaagtggcatctcaaacactagaatcaatggttgcaattaatgatgtgacttcaacgccggttcttcgtccagtggctacaatggataaaactgaaattattaagctagctgagcaaatcggaacatttgacctttctattgaaccatttgaagactgctgtacaatttttgctccgccgcgtccaaagactaaaccaaaattggatgaagctcgtaagctagaagatagacttgatgctgaaggaatgattcagcgagcaattgatggaatggagattacaccaatttatccaaatcaaaagttcttggatgataaggctcaagaagacgcagacttgttataaaaaagtgctagcagaatgctagcgctttttattttagaaagacaaaatatatgagaattgataagtatttggctaacatgaatgttggttcacgtaaagaagttcataatctcattaaaaagaagattgtgacagttaatggagaagttgtaaagacacccaaggagcaagttaaagaagaagaccaagtagcagttgatggagaaaaagtggcatatcagcaataccattattttcttctcaataaacctaaaggtgttatttcagcaacagaagataaaagtcaaaaaactgttctttctttacttaaacctaaagatcgttataaagatatagcgccagtaggtagactggataaggatacaacgggtttattattgttaacaaatgatggtgctttagcccatgagttgctagctcctaataaacatgttactaaaaaatatcgggcaaaaattgctggagtagctgatgaagagacagttaaagtttttgctagtggtatgacattaggtgatgggacaaaactaaaaccagcagaattaaagattttgatgcaagataaagagtccgatcaatcagaaattgagattgaaattcaagagggaaagtatcaccaaattaagcgaatgtttggagcagtcgggatgaaagtaatagaattagatcgaatttctatgggaaaattagtcctaccagctaacctaaaacgcggccaatatcaagaaattactctaacagatatcaagtagagaatgagaattatgaataaatatattttggttggtttctttattttgatttttccttttacttgcggttttttaaacatcgcccaccggggagataatgaacaaggaaagtttgcagagcatagttggattgcatatgatcgtgcagtatgtgcaaaagtagactatttagaactagatttacaacaaactgctgatcatgttctcgtagtgagccatgatgaaaacttaagtagagtttttggaattgataaaagcattgcaaacttgccttatcatgatctaattacatataaaaatcaaaatgatgagtccattcatcgtcttgtcgatgtctttaaacgttatcagagttctaacgtaaaatttatgattgaaccaaaagataatagtgataacgatatcaataatctacttagtttaatcaaaaaatatcatttacaaaatcgggtgttgttagaatcgttctcagagctagctcttttaaaaattcataaaagtgatccacaaattccactaactcaattagctggtgattttaaaatatcaccaatgctgcagtattatgcaaataatttttatgctaagaaagctgcggattatttaggtgagcataataaaaagtatttactctggggcattgatacagaaactcaaatgaagaagtattcgcgcccagaagaaaatgtttcaggaatattgacagattatccagttaaattggccactattttacatgaaaataatgtctttaaaagatactatgaagcagccgcttaccccagtgaatcaatttcaggttatatgtatttgaaaaatggtaaaaaagtttatgttgatcaagttaaaatgaaagacaatcaacttttttatcatgtaaaacctaatatttggattagttatgataatttaaaaaattccaataagtttgctcctaaagcacaagttggcaaaatcaagttagaacatgatgttcaagtttataccgatccagcttttgaaaagaaaaccgagaagaaattacgtaaagatagtgcttggaattattttgcagtaaagaaaatgcccgggaaaactgcctataacttgggtggtgcacagtgggtaagtcaataattttttattgctagcttaattaaaacatggtaaacttataaccaacatatagggagtaaccggcataagggtgtacttacggcgtcaaaacgaaattaatttttccgctgtaagtttaaatggtgagactattggctaaactttttttgttcagacaatggtctctttttttataccaaagtctggttttcctattagatggagggtttaagtgaaagcatattatcgtgagagtaaagaggaagttctaaaacagcttggagctaacgaacaacaaggtttaactagtaaagctgctcaagaaaaattagctcaagtaggacccaatgctttagtagaaggtaagaaaaaaagtgttgtagaagtctttttagaacaatttaaagacctaatggttattattttgattgttgcagctgtgatttctgcatttactggtaacttagaaagtacagcagttattattgttgttttgattctaaatgctattttaggaacagtgcaacatgttaaggcggaaaagtcgctagaagccttgaagtccctatctgcccctgccgctaaggttttaagagatggtaagaaacaagaaattgccgcaaaagatgttgttcctggcgatatactcttacttgaagcaggggatttagtcactgcggatggtagaattttagataatttttcattgcaggtaaatgaaagttccttaacaggtgagtcaactaatattgacaaattagacacgacttttgaaaaagaagttcctttggctgatcgtgtaaacatggtatattctagttctcttgtaacttatggacgtgcaaatgttttagttacagcaactggtatggatactgaaattggtaaaattgctaccttaatgaatgaaactaaggagcgcagaacaccattacaagtttcacttgatcaattttcatctcgtcttgcaactgcaattttgattttctgtgccttgatcttaggattgcaaatgtggcgtggtcaacctttactagatgcattactatttgcagtagcattagccgtagcagctattcctgaagctttaagctcaattgtaactattgtgcaggctatgggaactcaaaaaatggctaaagaacatgcaattatcaaaaatttagctgcggttgaatcattagggtcagtttcagtaatttgttctgataaaactggaactttaacgcaaaataagatgactgttgaagacatttatattggcggtaaagttcttaagccggaagagttgaacttaagtaatcagttgcatcggtatttactatatgatgtagttttaaacaatgatgcaagtttatctgatggtaaaaaaattggtgatccaacagaatcagccttattagaaatgtaccgtaaagttccaggaattgatcttggtgacggaaaattaggcttatctgaaagtgagttaagagaacatttagatcgtttagaggaagtgccttttgactctgatagaaaattaatgagtactaagcacttaattcacactgttcctacaatttttgtaaaaggagcaatcgatgttttacttaaacgttgtgtgaatattcgttttggtgatgatgtccgcccaatgactgaacaagatcgaaaagatattttggctcaaaataatcacttttcagaaaatggactaagagtgttggcatttgcctataaggaaagtgatgaagagttatctactgatagtgaaaaagacttaactttcattggtttagtttccgaaatggatccacctagaaaagaaagtgttgcagctgttgcacgtgctaaagaagccgggattagaactgtgatgatcactggtgaccacaaagtaactgcagtagcaattgcgaaaaagattggtgttttcactgatggtgatcttgcattaacaggtttagagttagatgcattaagtgataaagaattagaccaacaaattgaaaaagtagcagtttatgctcgagtttcaccagaaaacaaaattagaattgttaatgcctggcaaagaaagaatcatattgtatcaatgacaggtgacggagttaacgatgcacctgcattaaagaaggcagacgttggtgttgcaatgggtattactggtactgaagtatcaaaagatgctgcaagtatgatcttgactgatgacaactttgcgacaattattaaagctgttgcaaatggtagaacagtttatgaaaatatccgtaatgcgattggatatttattatcgggtaacttatcagctatcattactgttttatttgcttcaatcgctgcattgccagttccatttgttgcagttcaacttttattcattaacttagttactgactctcttccagctttagctattgggatggagccaggaaatcctgatattttaaaacgtaaaccacgtgatcctaaagctagtttgttagataaaaaattcgttacacaaattagtattcaaggttttttaatttcactaagtgttattgctgctttcttacttggcttaagagatacaccagcaattgcatgtactatggccttttcaactttaacgtttgcacgtttactacatgggttcaattgccgttcacaacacagtatttttaagattggatttaaaaataattggtacagtttggcagcctttgcattaggtaccgtacttttagccttaattctttttgtaccagcattacatggactatttgcagttcaaccattaactgctcaagaagtatggttaattgtaattttggcaattattccaactatcttaattcaaatagtgaaagtgattagagaaaatagagattaattcttagctttcttcttattttctttcatgctataatcataaacaaagcaagaatcaagaggagtaatttcgcattacagagaaaagtcaatatgctgagagacttaaagaatattactagtagcttgattagctgattaattgaattttttagtaggttaatccggacacttcagcgccgttatcgcttataagagaggtataggttctatatctaatcgtaggtggtaccgcggaaaaatttcgtcctagacaaatatttgtctaggacttttttattggaggaatttaaatggcagatttagcacctaaatataatcctaatgaagttgaaaaaggaagataccaggaatggcttgatgaagacctttttaagccatctggcgataaaaaagctcatccttattcaatcgttatcccaccaccaaatgtaactggtaagttgcacttgggacatgcatgggatacagcaattcaagatacattaattcgttttaagcgtatgcagggctatgataccttataccttcctggtatggatcatgctggtattgcaactcaagctaaagttgaagctaaacttcgtacacaaggaaaagatcgtcacgaaatgggacgtgaagcttttgttaagcaagtttgggactggaaagatgagtatgcatcaattatcaagagccaatgggcaaagatgggtctttcactagattattctcgtgaaagatttacccttgataaaggtctttcaaaagctgttagaaaagttttcgttcaactttataatgaaggactcatttaccgtggtgaatacatcattaattgggatccaaaattggaaacagctcttagtgatatcgaagttattcacaaagatgataagggcgcattttaccacattaagtatccatttgcagatggttctggatttgttgaaattgcaactactcgtcctgaaactatgtttggtgatactgcagtagccgttgcaccaggggatgaacgttacaaagatattgttggtaaggaattagtattaccacttgttggacgccacatcccaattattgaagaccaacacgttgatccagaatttggtaccggtcttgttaagatcactccagctcatgatcctaacgacttccaagtaggtaatcgtcataacttagaaagaatcaatgttatgaacgataatggaactatgaatgaagaagctggtaagtatgctggtatggatcgatttgaagctcgtgaagctttagttaaggatcttaaagaagaaggcttcttaatcaaggttgaaccaattgttcactcagttggtcactcagagcgttctggtgttcaagtagaaccaagactttctaaacaatggttcgttaaaatgaagccattagctgaaaaagttttggaaaaccaaaagactgatgacaaggtaaactttgttcctgaaagatttgaacatactctggaacaatggatgagcgatgttcatgactgggtaatttctcgtcaattatggtggggacacagaattccagcttggtacaacaagaagactggtgaaacttatgtaggtcttgaagctcctaaagatagtgaaaactgggagcaagatccagatgtacttgatacttggttctcaagtgcattatggccattttctactttaggctggcctgatgaaaattcagaagacttcaagcgttacttcccaactaatactttagttactggttatgacatcatcttcttctgggtatcaagaatgatcttccaaagtttacacttcactggcaagcgtccatttgatgatgttgttttgcatggtttaattcgtgacccacaaggacgtaagatgagtaagtctttgggtaacggtgttgatccaatggatgttgttgatgaatatggtgcagatgctcttcgttggttcttacttaacggtacagctcctggtcaagatactcgttatgatcctaagaagatgggtgcagcctggaactttatcaacaagatttggaacgcaagccgtttcgtaattatgaacttgccagaagatgctaagcctgcgcatatgccagatacttctaagtttgatttggcagatagctggatttttgaccgtttgaatcacactgttagtgaagtaactagattatttgatgaatatcaatttggtgaagctggtcgtgaactttacaactttatctggaatgacttctgtgattggtacattgaaatttctaaggttgcattaaacggtgatgatgaagaattaaagactagaaaacaagaaaacttaatctggattcttgatcaaatcttacgtttacttcacccaatcatgccatttgtaactgaaaagctatggctttcaatgcctcacgatggcaagagtattatggtagctaaatatccagaaactcataaggaatttgaaaacaaagaagctgacagtcaaatggccttcttaattgaagtaatcaaggctgttagaaatatccgtatggaagttaatgcacctatgtcatccccaattgatatcatgattcaaattgatgatgataataataaagctgttttggataataatgctgaatatgtagaaaacttccttcatccaaaagctttatccgttgcagctgatattgaagcaccaaaacttgctaaaactgccgtaattccaggagctcaaatctttgttccattaactgaattagttaatgtagatgaagaactcgctaagatggaaaaggaagaaaaacgtcttgaagctgaagttgaaagagctgaaaagaaactttcaaatcaaggatttgtagcccatgctcctgaagcagttataaataaagagaaagaaaagaaggctgactacgaaagtcaacttgctggtgttcgtgaaagaatgaaagaattaaaggaaagtaaatagaagtgaaatttactaatgttgaccaggtaattaagagaatatattctttacccaaacttcatcctaaaaatgatctgagttatatccgaaggattttgaaacagttaaataatcctcaagatagtgttaagacaattcatgttaccggaacaaatggtaaagggtcgacatcctattatttgagtaatctattgcaaaaggccggtcaaaagactggcctttttgtgtctccttatatatatgaatttaatgaaagaattcaattaaatggtaaaaatataagcaataatgatctcattaaaacagctaatgaaattgagatggcaatagagatactaaaaaaagatgatcctgatttttctttagtaacatttgaatatgaagtagctttagcctttcaattttttgctcaagaaaactgtgactatgcagttattgaagtagggattggaggagagcatgacaagacaaatgtaattattcctgaagtaagtgttattacaacaattggattagatcatgaaaaaataatagggccaactttaaaagatattgctaaagaaaaaagtggcataataaaatctaatagacctgttgtcttaggaaatgttcctcaagatgtactagagattttacttaataaggcgcaaagtgaaaattcaaaatcatttttattaggaagagatttccaaataaaaataatgcccgatgtgattaaatatcaagattcaaagaatatctataattttgcattacggcctttggtagaagcttatgatatcgggatagcagttcaagcgattcaattgttgcaacttgatttagatagaaaaaagattgaagaagcaattaatgaaacccgtattcctggtagatatgatgtgattcaaactagtcctgaaatcattgtcgacggggcacataatttacaagcgatggagaatcttttaaacttagttcgaaagaagaaaaaaggacaaatctacgtgttacttggaatgatgaaagacaaagacctgggtccagtcacaaaattatttaaggatgaaaaagtcactttaacacggattgattatcctagagctgctagattagaagattttccaaaagaagcacaaaaagaatttgaatataaagaaaattttgaagaagcttatacaagcttgaagaataaattgcaggcagatgatatgctattagtgacaggatctttttatttagttggtgcagttttaaattactgtaaaagaggtaaagatgaaagttgaagatattgctgatcctattgaaggtataatttttgatatggatggattattagttaattccgaaaagttgtattgggatgctaatatcgtagctgctaaagaagcaaacttagatattcctgatgatagttatctgaaactagttggttcttcagttaaggaaatggaagatttttatcataaacattttaagactgaagccgatcgagataaatttattaaaagaactgatgacttagtctggaaatggactgatgaaggtaaacttagacttcaaccaggagtacgagaagcattagcggtatttaaagagaaaaatatcaaattatcaattgcatcgagtaattatgagaatgtaattgtccataatttagatgttttaaaaataaaatattactttgatttttatctaagttataaagatgttgaatctggaaatattaaagctaagccagcaccagatatttatctactggctgctaaaaaaatgcaattacctaaagagaatctactagtatttgaagattcaagcacaggtgttgcagcagcaagtgctgcgggtttaaaatgcgtaatggttccagatttaaagcaaccaacaaatttagataaagataaggcgacattaatctgcaaagatttttatgcttttcttgaaaaaattaaatagttttttcgtaataaatatcaaaggagtaattgatatttatgaaaaaagaagaattattgcagactgatgttgatttaataaagaaattagctgaatcgttagagaaaaaagatattcttacatttaatagtttatttagaaaactagatgaggtagggatcagtagctttaaggaactatggcaatttgctgctagcccaagttgcaatgatgaggtagcaattttacttcaattattattggagcgcgtaaagagcgtcaataataagaaaattgagagcttttactcgagttcacaagtaggatgctatatcgcggataaattatgtggccgtccgcaagaagagctatatggaatttatttggattcaaaaaataagataattgctgaaaaattaatttttcagggaacggtaaatagagcagttgctcatcccagagatatctttcgatgggctgtcatttataatagtactgccttttttgtagcccataatcatcctagtggggatgaacagccatcgcaacatgatttacgctttacaaagaagttagtagaagcaagtaaatgcatgggaattgattttttagatcattttattgtgacagataatacctatttaagctttcgagagactgaacttctttaagtcttccttaagtattaggcaaatttccttaaagcaaatttttacatcagtgtttctatgctataatatctaagactaaataaagatacgatttaggctaaaataattaaagagataaatttaaggagagattttgcgtgtttggattaggatctaaaaatattgggattgatttgggaactgccaacacactcgtttatattgaaggtaaaggtattgttttacgtgaaccttctgttgttgctaagaatactcaaacgggtgaagttattgcagttggttccgaagccaaagaaatgattggtagaactcctggatcaattgtagctattcgaccaatgaaagatggagtaatcgcagattacgatacaactgctgctatgcttaagtatttcatggaaaaaacagttggtaattcaaaaccagctgcaatgatttgtgtaccatcaggtgtaactgaagttgaaaagagagctgttattgatgcagctagagttgctggtgcacgtgaagcatacgtaattgaagaaccatttgctgcagctattggtgctggccttcctgttatggatccaacaggttcaatggttgttgatattggtggaggaactactgatgtggcaactatctcattaggtggtattgtttcatctcgttctactagaatggcaggagataagtttaatagttcaattgcaacttatattcatcaaaattacaacttattaattggtgaaagaactgctgaaactattaagattcaaattgcttctgcttcagttgaaaaggcaaaagaaattgaatcaatgaatattcgtggacgtgatttagtcacaggattaccaaagtcaattgatattaatgcagaagatgttgcaaaagctattcaagaagtagttcaaaatataattgtagcaattaaagaaactttggaagaaacatctccagaaattgctgctgatgttattgaccatggtatcgtattaaccggtggtggagctcttttgaagaacttaccggaagttatttcagatgctactaaagttccagtctttattgctcaagatccacttgattgtgttgcaattggtaccggtgaatctctcaaaaatattgaagttatgcgtaagagacgttaatttagagaccggcgtaaaagccggtctttttctattaacttttaaattaggaagatagtagtagatgaaaaaatttctcaaaaacaaaaagttattgacaatttttgtcctagttattttagttttaagtatgttatctatttctgttcgcttacgtaataggagacaatcaccttttttagttcaaaaaattggtaatgatacggtttccatagtaacccgagtagttaattggccaattaacttaatttctaatggggcggctaatgtagaagatctgtttaatactcaagctgaaaacgatcatttaaaaaagcaagttgataatcttgctcaaactaaggctcgaaatagttcacttgaagctgagaacactcagttaaagcaagctttaaaattaaagaaaactttgacggactatacaattattaatggttcggtgatttctcgtgctgcagatacttggtcagatttattaattattgatcaaggttcaagagcaggtgttaagaagaatatgcctgttatggcaggtaaaggtgtaattggacgggttgttgaggtaaatagtactacttcaaaggtcgaactgattactacaactgataaatcaacaaataaatttgctgtagaagctgatgcagctaatggtaaaaaagttcatggagtaatttctgttgttggaaataatcaaatagcatttacccaagtagttgatggtcaaaaattgaagaaaggaactcgagtttatactagtggaatgggtggcctatctccaaaaggtctcttaataggaacagttaagaaaacaacccgggatacttttggcttatcagatgttgtcgaaattcaaccagcaggtaaccttaacgatccatcagttgtatctgtaattaaaagaaaggttgaagagtaatggcagaattacgtcgatggtatgttgccattgctttgtttgtggcattaattctagatggagtattagcttataatttacagacttttatctttcatcgaggtttttctggaagttgttggttaacaattattgggattaccttaatttctctatgcgatgataaaaatgatgctgatatttggctctgcttaggattaggccttattgcggatctatactatttaggaattattggaatttatactgtagcttttcctttaatctgttttattattcagcaaagtgctcgctttcttccagaagtattctggtttagattattaatctgtttagttacttatttatgcgtaagtgcttatgtgtttttgatgtttaatatggtaggcataatccaattgtcttttgctagtttttcacgtagtattttgcctaatttactatggtgcttaattcttgttttatgtacttattggttctgggtaaaactagctgaagagtatccatttttgaaaaaagaatactatttctaaacaaaaaagagtcgctgttaagcggctctttttaacatgcaaaagattttaaaattgaaagacaccagttccaattaaagcagtagctactaccccaagaagggtgataactgccataaaccaggccataataatagttaacttttgaaatccggattttttcttacgttttctcatatgtccctcctaaattaataattctagtgtaccatgttttaattgtaattttatatttaattgaaatagtttaaaataaacttattggaggttttcatgaattttttgcttatctttttaattcctttatgtggaattatcgttgctgcttttttagtgaaattatttcctaaggctcaatttagtggttatgacattttgccttttttctttattgttgcttgtcagttattaactcaagaaacaaagcagccatcttttttaccgtatggatttttactttactttattttagttgtaattgtttcaatttatactgcaattaaaaacaaaaacatttcagtgggtaagacatttggaatgttatggcactatttagcagcatcatctattgtttggtacgttggtctcttaattttgcttttactataaaaattttccccacttttttaataaaccttaaactgtcctcaatcataataatgagggcattttttgttggataaaattataattatcataaaataacgtaatatataaataaaaagtataaaacttgtggtagaaagtggggaagtgtggtaaattattcattggaaagggggctagaccatgttcatgggcgagtatcatcataatctcgacagcaagggccgactaattataccagccaaatttagagttgagattggtgataagatgatatttactcgtggaatggaaggctgtatttttggctatccaattgaagaatggcaaaaaattgaggctaagttagccaaacttccactgactaagagaagtgcacgtaagtttacgcgacttttctactcaggcgcgatggagagtgagtttgacaagcaaggacgtgttaatctgaccatgacactgaaagagcatgccgcactcattaaggaatgtgtaattgttggtgtttccaatagaattgagatttggtcagcagaacgctggaatgatttctcagaggaagccaacgaaaactatgacgatatcgcagaagacttggatgacatcgagttataaaattatgaaattcaagcataaaagcgtgcttttgcacgaaacaatagacaatttaaatccaaaagatggtggtctttatgtagacgcaacttttggtggtggtggtcatgcccgatatctactcagtaagttaaataagggtactgtgattggatttgatcaagatgagtatgcaatttctatggcaaaagagagttttgccaaggagttacaggtaggagcagaacctcgattaatgttggttcatgataacttctgtcatttgaaagaaaatctggtagagctggggatttcagatggaatagatggtatttattacgatctcggagtttcgtctccacagtttgatcaacctgaacggggtttttcttatcgtttcgatgctcgattagatatgaggatggaccaaagccaagagttagatgcttatacaatagtaaacacgtggtcacaaaaagaattaagtgacgttttgtataagtatggagatgaaaagttttctcgtcagattgctagaaaaatagttgatcgaagaaaagagaagccaattgtaactacttttgatttagtagatgtgattaaggatgccattccagcatatgcacgacgaagtgggggacatcctgcgaagaagagctttcaagctattcgagttgcagttaacgatgaattaggtgtattacaagaatctcttgaagaagcaattaagctattgaagccaggtggtcgaattagtgtaattacttttcagtctcatgaagataaaatcgtcaaaaagatatttaaaaagtattctgaagtcgaaataccacggggaatgcctatggtaccggctgacagtaaaccaacattgcgattgattagtcgcaaacctatcatggcaagtagcgatgaattagaggaaaataatcgctcacacagtgccaagttaagggttgcagagaaattataatttttagttagtatttaaggagaaaaagatggctgatagctcagcaagaaatttaaattatcaacaaagtcaacagcagactgagcagccaaagaaagcaattgttcttaatcctaaaagcgttccttggacagcatttgaaaaaagtttagtcgttctaggttcactcattacattaggtttaatgattttattggtttcagctagcatttccgctactagtgctcaacataaattagcaaatgttgagcaaacaataatttctcaaaaaagtcataacactgatcttcgtcagaagattggtgaattaacgtcaactactagaattaataaaattgcccgtgatcaaggcttgcacttggttgagagtaacattaggaatgtccgttaatgaaaaagtttaataacttaaatagaaatagatccaaagcccacggctaccgctttacggtggggagaatcctccagctagtcttggctttggtttttcttgtatttataggtagatttttatatatagggatttcaaatcaggttgctggcgaaaacctaaataagcgtgtaaatcagatttataggcgaaatgaggttttaaaggcaacccgaggaacaatttatgataaaaatggtttaactcttgctgaagatgcgcatgtctttactgtatatgccatcttagataagagttcaattgattatcataataagccaatgtatgttacgaataaacgcaaaacagcacaaaagttggctgaagtacttcctttaagtgaggaaaagatatattcatatttgactccgaagcataaagctttccaggttgaatttggttcggctggaacaggtttaactttatctcaaaaggaaagaatcgaagagatgaagttgccaggaattaaatttatcgaaactccatctagactttatcctaatggaaattttgcttctcacattattggtttggcacaacccaaaaagaaccaaggaaacagtactttagttggtacgatgggaattgaagcatactttgataaacaattggcaggtaaagatggttatcgcgaagcttttgttgatgcagaaaattatcaattacctaatagccaaaagaatgcacgtgctacaaaagatggagacaatgtttacttgacacttgattcacgactgcaaacttacttagaggttttaatgtcgcaagtgcaagataaatacaagccaaaagctttaacagcagttgtagaagatattaaaactggtaaaattctggctgcttctcagcgtcctacctttaatcctcaaactaaaaagggattagatacatcatggcgaaatatgttagtgcaggattcctatgaaccgggatcagttttcaaagttttaacttattcaagtgcaattgaaagtggtcattacaatcctaatgaacaatacaagtctggagcagtcactgttcagggctcaacaattcatgactggaacaatagtgggtggggaagcattccatttagccaagcatttcctcgttccagtaatgttggttttgtaaaacttgaacaaaagatgggttcaaaaacttggaaagaatatttgaataaataccgaatcggtaaaaagacaggggtaacgcttcctggagaaaccgcaggtattttaaacttttctactccgttgaatcaggctgttactgcatttggacaaggggttaatgttaatgcaatgcaaatgatgcaagcatatagtgccttggccaataatggtcagatggtaaaacctcaatttgtcgaaaaaatagtttcaccttctggtaaagtagtagaaaagtttcaccgtacaaaagtcgggacacctatttattctgctaaaacagctaaaactgttctaaaaggaatgcaagatgttgtaaacgcatcttacggtactggtgcagcttataaaatgccaggaaagagcatcgctgtaaaaactggtacggcacaaatagctggaccgcatggtggatatttgactggggataataattatattttttcagtagttggggtaacacctgctaataatcctcgttattgtgtttatttaaccatgaagcaaccacaaaaaatgtccaaaccagctgaaacaattctttcttctatttttaaaccaattatgaatcgcttgatttcactttctgattcttcagcaaaggttaatgaaaaagtaactgttccagctttaactggtaaaagtgttgaaaaagcaaaagaagatgctaataatgcaggagtttcagttgaagtgattggaactggaaagaatgttagtcggcagtcagtaggagccggtgtaaaagaagataccgatacaaagattttcctatatactggaggaaaagttacatgtccaaatatggttggctggagcgaagatgaagttaatagcttcatgacgacaactgatattccaattacgattaatggaaaaggaaaagttactaaacagtctattccggctggaaaagtaattgataaaaatagtaagctatctgtaaacttaaaatagtaaaagttaaaggagtaatacaaaatgcagttttctttgataccgttcattagcagctttgctcttacggttatcttcttaccgttgtttattggtttcatgcgaatgaaacatgaaggacaagttattagagatgaaggccctaagtggcatgagaaaaaatcaggtacaccaactatgggtggagtagtctttatgcttgccggtgttatttctaccttatgggtgttgatttggcaaaaagatttaaataagactgcatggattttaattattgctttcttaggatacggaattattggctttttagatgatggaattaagctatatttcaaacgtaacttaggcttgagagcatggcaaaaattattaggacaaattattattgcagctttaattattacactagcctttagtgatcattttgcctttgaattatatattccttttgcaggaatggtaagaaattccttcctctttagtttatttgtccttttctggttggttggtttttctaacgcagttaacttatctgatggtttagatggattagcaactggtttatccattattgcttatgctacttatgcttggatagcttaccaagaaagaaattgggttatcgttgtatttactctcagtgtaattggtggtttagtaggtttcttcattttcaatcataagccagctaaaattttcatgggagatgcaggttcattagctttaggtggaggattagccactgtatcgattttccttcatcgtccatggtcattgctgttaattggaattgtttttgtattagaaactttaagtgtgatcttacaagttatttccttccaaactactggaaagagaattttcaagatgacaccaatccatcaccatttcgaaatgcttggctggtctgaatggaaggttgatattgtattttggattgttggtttaattggaagtattatttatttaattatctggggttaattttaaaatgaaaaaaattaagacatacgaaaataaaaatattttgattttaggcttaggaaaaagtggtttttctgttgctaagcttcttttaaagcttggcgctaagctgactttaaatgataaaaaagatttgtctaacgatgatcgtgctgctgaattaggcaagttaggagttagagttatttctggataccatccagtagagatctttgatgaggaaaaatttgattatcttgttaaaaaccccggaattccttatgaaaatccaatggtagagaaggcagagaagttagatattccagttattaccgaacctgaaattgcacttaatgtcagtgaagcaccatatgtttgtgttactggctcaaatggaaagacaactacggtcatgcttacccaaagaattatggatcataatttatctaaaaatggtggtcatgcttatgcagttggtaatattggtgttccaatttcagaagttgttgaaaaagcaacttctaaagatctcctagtagtagaaatgtctagtttccaattacttggggtaactgatattaagcctaaagtagctgccattgttgatatttataataatgttcaccttgactaccataagacttttgacaattatgttgaagctaagcttagaattactcaatctcaagatcaagatgattatttcattgctaactttgatcaaaagaatattttagaaaaagagcttgataagacaaaagctaaggttcagacattttcggaaacagataaaactgccgactattttattggtgatgaatatcttgaaagcaaagacgatcatcacattatgaagatcagcgatatcaagatcccaggtattcataaccaacaaaattgtttagtagcgattgccatttctaaattaatgggtgcagatgatagtgacattcaatatgcattaagtacttttactggtgcgactcaccgtttgcaatatgtaatgacttataatgatcgtaaaatttataacgattcaaaatcaacgaatattgaagctgctactgtagcgattccatcatttaaagagcctgaggttttgattgcgggtggattagatcgtggatttatgtttgattcactagttccactatttaaaaagcatgtaaaatcaattgtactttatggcgaaactaaatatcttttagctgatgccgctcgtaaagcgggtattaaagatatcgtaattgttaatactttacaagaagctgttccgcgagcatatgaattaagtgaagcaggagatgttattttgttttcaccagcatgtgcatcttgggatcaatttaacacttttgaagaacgtggagacttttttgtaaaatttattaaggaattaaagactaaataaaaatgagagtaattttttctggtggcggaactggtggccacatatatccaattatggcgttaattgaacgtttgaaagaacgtaaattagttacaaatgatgaaattttgtttgttgggactgatcgaggattagaatcgaagattgttcctgcggcaggagttccttttaagactttaaaaatcaaaggatttgatcgaaaacatcccctaaagaatttcgaaacaatcgaattatttattaaagctacaaaagaagcaaaacaaattattaagaactttaaacctgatgtagtcgttggaactggtggatatgtatcaggtgccatagtttatgaggcagctaaaatgcatgttccaactatcattcatgaatctaattcagtagttggactagcaaataagtttttagctcattatgttgataaaatttgttatacctttgatgatgctgcaaagcaattttcagagaaaaagaaattagtaaaaactggtaatccacgctcacaacaagttcttggtttaaataaagaaaacattgatattgctaagaaatgggatttaaatcctaacatgccaactgtacttatttttggtggctcacgcggtgctttagcaattaatcaaatcgttgaaaagtctttatcagagcttgaaacaaaaccatatcaggttatttgggcaactggacaattgtattatggtgatgttaagaaaaaattagccggtaaagaagtgaattcaaatataaagattgttccttatatcgataatatgcccggcttactaccacaaatgacatgtgttgtagcacgatctggagcaactagtctggctgaatttactgcccttggtgtccctgtaattttaattcctagtccaaatgtaacgcataatcatcaaatgaaaaatgcgcttgatatggaaaaagcaggagctgctttagttattgcagaaaatgatttaaatcctaataactttgtttcatcaattgatcatattctactcgatacaaattatgcaaagaagatgagtgaagcatctaagaaattaggtgttccagatgcatctgatcaagtaatttcggtgatggaaagtctaattaaaaataaatagtgaaagggagtgaggcatgtggctaaaagaaaaataaccaaaaaagatcctaaaaaagaattatcaggatggattgattataaaaataagacaaacactaatgaaaaaagacgggtctctgcctcactaactaaattgcaagctgaacgtcggcatgctttattgactcgattaggttttataattttcttttcactgtgttgtattttagctttaggatactatatttctccaaaagcaaatgtagcaagcgtgcaggttaaaggagcgcctgaattaaatagtaggcaagtagtaaagactgtaggtatttctcctgaaaacaaggttgtcttttgtctcctaaaaggaaaagaatacagtaaaaaactatcagctacttttccagaaatagaaaaagtacaagtgggcgtccaaaaagcaaatcatttgattttaaatatcaaagagcgaccagtaatcggatatattcatgaaggtgacggctatcgcaaaatcttggcgactggaaaagtaggtagccaaattatcgcaagtaacaaaattgataaaaataagcctttgtttactggatataatcaaaaagtctctcttagcgaagatatcaaggtttatgccagtcttccacaaaatatccgtgaccaagttaaaatgctgagtggtgaaacacgaaggccaacgcagattattttggtaatgaaagataataatatagttattggaaatctttctaccattaaaggtaagatgcgctactatgacaaaattaaaagtcagctaagagaaccatctgtaattgattttgaaattggtgcttatagtagaccgctcacacaggcagaaaaagtcaaattaggactgacttgatattagtgagaacttaaaccatatgttaaaatttattgtatagttatgttttgggggcattaccttggataaaactgatttacttgtaggcttggatataggaacaacaagcgtaaaagcagtagtcgctgacactgcatctaatgaaatgcaaattattggtgctgcaaatggtcctactaaaggaatgcggcatggaaaaattgttgatattgatcaaactgctgaaagtattagtgctgttttaaagaaagtagcgcaaaagacaaattcaaagatttatcgcgtagtaactggaattccagttggattgcttcaattagaaaatgctgttggattaattaacattgaagaaaatggcagagaagttactgataatgatgtaaaacgtgttttagtaactgctattgatacagcattaaaagatggccgagaagcaattgctttcttacctaataaatttttaattgatggaaaaactgatgtagatgatccgagaaaaatgattgctcattcactggaggtacacggtatattattgacggcacctagtgcagatttacataatattcgcaaggccatcgaaagagcaggatatcagaataatttctttgtacctacaccgttagcaattgccagtgttgctcttgatgaaggagaaagaacctttggtacagttcttctggatctaggtggaggatcaactactgctactgttattcatgaaaataagattaagtatgcgacaattgatttagagggtggaattgatattaccaatgatatttcagttgttttaaatacttcgaaaaaagaagctgaaaaaatcaaactacaatttggttatgcagatccaagcttaacttctagtgataatcaatttccagttaatgtagtgggtgaaaatgcgcccaaaatgattgatgaagagtatttaagtgaaataataaatgctcgtcttgatcaaactttcagtcgaattggaaaaggattaaaatctcatgatgccttcaagttgccaggtggagttgtgattactggtggaagtagtgcactccagggaattgatgacattgtaaaagaagattttggcgtaaaggctagaatttttcaaccagatcaaatgggactacgcaatccaatgtacgctgctagctatggagtagtaaattatgcttatagtttggctgatattgattacttggttaacagtgttatttatggaaaccagattacgtctccggtttctaatcaatcttcgtctcaagaaaatatgaaatttttcaaaagacgcctaactcctagtgaaatggagcctaaagaagattataataagactagtgctacatcaacggtctctacgtctgaagagaatgatgataataagaataataaaaaaggaatcaaagaattctttaagaaattttttgattaaataaggtggtttagtaaatggattttactttcgattctgatgacaacaaaaatgcagtcattaaagtaatcggtgttggtggtgccggtggtaacgctgtaaaccgaatgattgatgaaggagtacaaggagtttcctttatcgcagctaacacggacgtacaagctcttaatagtaataaagcagaaaataagattcaacttggacctaaacttactcgtgggttaggtgcaggttctcatcctgaagttggtcaaaaagctgctgaagagagccaacaaacaattgaagactctttaaagggcgctgacatgatctttattactgctggtatgggtggtggtactggaactggtgctgctcctgtaattgcaaagattgcacgtgaaactggagcattaactgttggggttgttactcgtccctttacatttgaaggtccaaagcgttcaaaaaatgcggcagaaggaattgctcaattaaagcaatatgttgataccttggttatcattgctaataatcgtttattagaaatggttgataagaagacaccaatgatggatgcgttcaaagaagctgacaacgttcttcgtcaaggtgtccaaggtatttcagatttaattacttcaactgactacgttaaccttgactttgcagatgttaagactgtaatggaaaatcaaggtgctgccttaatgggaattggtcgtgctagcggagaaaatagaacagttgaagctactaaacttgctatttcatctccattacttgaagtatcaattgatggtgctaagcaagttctgcttaacattactggtggaccagatttaactttatttgaagcgcaagatgcttctgatattgtttcaaaagctgctggagatggtgtaaatattatctttggtacgtcaatcaatgcaaacttaggtgatgaagtagtagttactgttattgcaacaggaattgactcaaaggctgaggaagaagcttcaaaacaaccaatgcgtcgtccttcacgtccagcacgccaagaagtagtaactccagaacctacaaagagtgaacaaccagaagtatctaaggctgcttcagtagatgataccgaagttaaggttgcaaatactatttctcacgaagctcctactcaatctattcctgaagtaaaagcagaaaagaaagaatctcaagatactttacttgaccccacaagcgtttggaagcaagatagaaaagagaacaatcgtccacaacctgtagagaataaagaaaaagatgacgatgaatttgattcatttagttcagacgactccactagtatttctcaaattgaaactagtgtagatgatgaatcagataatgatattccattcttcaaacatcgtcgtcaagattagtatttggaggaagagattatggctttcgataaattaggtagattttttggtatctctgaagatgatgaaatgaatgaagtgccatatactgaatcagaggaacagcaagaagaaatccctcaaactcaaaaaaatgagagaagagcaaatgttgtttctattaattctggtgttagtgctacgagtaaaatcgttttatacgagcctcgtgtatattctgatgcaaaagaagtagctcaaaatcttctaaataacaaggctgttattattaattttgcacgtatggatgatgaacaggcacgtagaattgttgattttattactggtactgtttatgccttaaacggtgaaattcaacgtgtgggggacaagatcttcttagcaactccaccaaaatttgaaactgatggtaaaattgctgaattggttgaaaagaaagataaaatggattaatggtattttcaattataggctggatattacgcattatttctgatttattaaatatctatagctttctaattgttatctatactttactaacttggatcccaagactacttgtgactaaagtggggcgagtactagggaaaattgttgagccttatttggagatatttgaacgttttattcctccaatagctggaatttcctttgctcccgttgtagctttgttagtaatttattttgtaaataattatgtcctttattggatagcaaatataattaggtacgtgtttattagataaaatggaaaaaagacaagctagtagtttttatcaacattttgatgaaagtgaaagaccgacggtggattatttcgtcggtctttttaatcagtttttatttaaaaatgaaccgattttaactgattttcttaatcctagagaacaatatatttttcgagaaatagttggaggatatgcacagttatatagttttggcggcttttcgaatgcggaaaagaagcgaatgcttttatgtgattggagtgaagggtacaagcccgatgaattcaatatttcgcttttagaaattgcttatcctcaaaaatggtctgaactcactcatagtcaaatcttaggtgttttgacgcacctaggaattgaattagatacttttggtgatattatcaatgatgaaaacggaaattggcagttcttcattaaagctgaattgaaagattattttcttgaggaaattgatcgaattggaagaacaaaagtgaaattatctgaactgcccctatccaaagttttagtgcaggaagatgatagcgaagaaatgacttcagtagcgatctcacttcgacttgatgctgttatcagtgcgattacgaacttaagcagaagccaagttaagaaaattattgaagcgggagaagtgaaattaaattggcatcttgtaacacaatctaatataattatttctgtacaggatatgcttagtattcgccattatgggagatatgagattattaatcttgccactacgaagaaaggtaaaaaaagacttgaaataaaagtatggcaagcaaagaaaaggtgataatatgacattaacgccaatggatatccataataaggagtttagtacaaaacttcgtggatatgattccaagcaggtagatggttttttagatcgaattgttgatgcatatggggatgcactcgatcaaattgttgatttaaaaaatgaaaatgttgaactaaagaaaaaagtagataaatttgaaaaggttaaagattcgattaatgagtctttaatttcagcacaagaaaatgctgaagaaattaaaaaaagaacaaataaagaagcacaagaaattattcaaaaggctaaccaagacgctgacgaaatagttaataaagctcgagatgagggcgagaaaaaaagagctgaccttcaaaagcaatatgataccttaaatcatgattatgagttacttaaggcaaaagtagaagattttagagaagcagttcaaggaatgttaaaagatcagatcaaagaattaagtgattctgattggcaatattacctagataaatactatggccgctcccgcttatatccagctgatgggtcacagcctctcgaggatgagcaaattccggatggaccactagaggatgaagtgccgtctgaagaaactaattctgctatttcagaggttgacaataatacagtaaatgaagtaaactctattcaagaaaaggaagatagtgctgaactcttagatggagaaaactctgttaaggaaagtatgcatgctacggaggaaagttctgagcgtcgcgatggtccagtaattatttttcctgatgatttaaaagataattaaaatttaagtcgacagtaacaacaagtagataccttagcgagttagtgatggtgaaagactaacaactttcgaaagttaatcagctgccaattgacttaaacgttttctgtacgatacacagagaataagtggaatagggtaagtgtaccctattcaatttaggtggtaccacgagaagcttcgtcctatttgggatgaagctttttttgattaagaaaggattttttatgagagtcaaagatacattgaatttaggtaaaactaaatttaaaatgcgcggtaatcttccagttcgtgaagctgaatggcaaaaagaatgggaagaaaataaattatatgaacaaagattaaaacttaatgaaggcaaaccccgttttgaccttcatgatggtcctccatttgctaatggtaatattcacatgggacactccttaaataagatctcgaaggatattatcgttcgtttcaaaaatatgaatggttactatgctccttatgttcctggatgggatactcacgggcttccagttgaacaacaattagctaaaaagggcgttgaccgtaaaacaatggatcgggctaaatatagagaactttgtcgccagtttgcggaagaacaagttcaaaaacaaatggccgacttcaaacgcttaggagtaatggctgattgggatcatccttacattaccttacaaccaaaatttgaagctgaagaaattagagtcttcggtgaaatgtttaaaaaaggttatatctataagggtaagaagcctgtttactggtcttggtcaagtgaatccactttagctgaagctgaagttgaatatcatgacattaaatcaccaagaatctatgttgcttttccaattaaagatggaaagggtattctagattcagatacttcactagtaatctggactactactccttggactattccaagtaatgtcggaattactgtaaatcctaaatttgattattcagtagttgaagttaatggtaaaaagtatgtcatcggttcacaacgtctttcagcagttgctgaagatttaggttgggaagattataaggttgttaagaccttaaagggtaccgactttgatagaatgacttaccaacatccactatatgatgtaactggggtgataatgaatgatacttatgttactgctgatgatggtactggactagttcataacgctactggttttggtgaagatgactacaatgtcgggcgtcgctatggcttaccagtatttagtccaatggatgcacaaggtagatttactaaagaagtgcctgatccagacttagtgggaatgttttatgatgatgctaataaagttgttgccgataagcttgaaaaagctggcgcactcttaaagcttagcttctttactcactcatatccacatgactggcgtactaagaaacctgttatttaccgtgcaactactcaatggtttgcttcaattgacaaatttagagatcaaattttagcagaaattgaaaaagctaatttcatccctgcatggggtaagacccgtctttacaatatgattaaagatcgtggtgattgggtaatttctcgtcaacgtgcatggggtgtaccacttccaattttctatgcagaagacgatactccaattgttactccagaaactattgaacatgttgctcaaatctttgaaaaagaaggttctaatgcttggtacacttatactgcagaagaactacttccagaaggatttaagtcagaacattcaccaaatggtaagtttagaaaagaaactgacatcttagatgtttggtttgattctggttcttcttgggctggtgtaatgcaagagcgtgatggtttaggtttcccagcagatttatatcttgaaggtagtgaccaataccgtggttggtttaactcaagtttaattacttcagttgctgtaactggtaaagctccatataagcaagttttatctcaaggttttgttttagatgacaagggacacaagatgtctaaatcattaggtaatgtaatttcacctaatgatgtaatcaagcaaatgggtgcagaaatcattcgtttatgggttgccggagcagatactacttctgatgtagcagtttctcaagatattttacgtcaatctgctgaaagctaccgtaagattagaaatactatgcgtttcatgcttgctaatacttctgactttgatcctaaggaagatgcaattgcttatccagatatgtccggtgtagatcaatatatggaaatcaagttaaatcgcttgatcgaagaggcaattgaagcatacaataagtttgattttaatagtgtttataagaaagtatttagcttcatttctaatgatttatctgccttttacttagactttgctaaggacattctttacattgatgctgaagacagtgaaactcgtcgttcaatgcaaactgtaatttacgatgttttagttaagctaactaaattgatgacaccaatccttccacatactatggaagaagtttggggttatctcaaggaaccagaagattacgttcaacttgctaatatgccagaagtagaccattttgctaatgaggatgaagttttagcagattggaatgcctttatgaaagttcgttcagatgtgttgaaggcacttgagaaagcacggaatgctaaggtaattggtaagtcatttgaagcacacgttactctctacccaactgaagaaacgaaggcacttctcgataaattaaacgctaatatcagacaaattttgattgtttctgatttaactattagtgatgaagaagcacctgaaaatgctgaaaaattgccaactgcatccattgtagtggaacacgctgctggtgaagtttgtccaagatgtcgtcgtactacaaccgatgttggtagtgacccacgtttcccagaattatgtgcgcgctgtgcagctatcgttgctgaaaactttcctgaagcagaaaaagaaggtttagaaaaataatgcgtaaaggtactgttaaacaatttgatccaaactctgcgtatggatttattgaggatgatttaactcattcatcttacttcgttttttataagtcaattaaagaagaaggttataaaaaactgaacgtaggtcaaagagttcgttatcaattagcgcaaggaaaaaagggtctacaatgtatcaacgtttatgttgatcatgactaaaaggagaaattaagtgaatctgagagaaactgaaatctcaaataaacctattttcgaaggtaaacttattgatttaaatgttgaaactattagtttgcctaatggaaaaacagctactcgtgagatagttaagcatcctgatgctagtgctgcaattgccatcaatgatgagaagaaaatgcttcttgtaaagcaatggcgtgagcctattaaacaattaactttggagattcctgcaggtttaattgatgagacagatgcttcacctcttgatgcaatgaaaagagagttgaacgaagagggtggctacaaggccgagtattgggaaaaggtaagtgaattttatacatctgttggtttttgtgatgaaaaaattcatttattctattgtgatactttgtcaaaaattgaaaataaacgtcctcttgatgaagatgaatttttaactcaagaatggtacagtctgccagaattaaaacagttaattgcttctggagaaattatggatgcaaaaactgtaatggcaattacattttgggaaaatatgattttaacaggaaatcaaagtaatgactgaaaaacgagcagattatcgtaaaaagcaacaaaaagaaaaagtaagcaaaattttcgataattttaaacgattgaggaaagataagcatcaagctgatgtaagtgatcaaaaagttgaggttcaagattcttcaaaatttgaatcaagagaggatctcgcaaatcgtgctttaaaagaaaagcgtgaagataaggttgatcgtttaaaaaaacgtctgaactatgcgattttaattgttgttgttttgttagttatagttttgttcgctttgtttaaactgtagatttagaggtaagaaatgaaaatcgcaattattgtcccaatggaagaagaagcagaattctataaaaagcattttaagtctgaaaataaagaagtttttggcacaactgaatttgatcatttttcagtaaatggaaatgacatttacttaggattaagtggaatcggtaaagttaatgcagctatgaatttgactagcctgttaactaaagaagatattgatgtaatttttatgactggctctgctggatcactgcaagaagatgtaaagagaaaagatctaattttgcctaataagtttatgtactatgatgctcataatactagtgcaggtaactatgtggaaggacaaattccccaggaacctgcaggctatactctggataattcattccgtacaaaatttgcagcatatttaaaggaacatgatattccttttaaagaaggattgattgtaactggagatagttttattgcttctgaagcacaaaaagatgagattaaaaagaatttctctgacgcattgggagtagagatggaaggagctgcttttgcacaagtagctagacattttaatactccattggttgcaattcgtgctatttcagataatggggatgctaatgctgacaatgactttgataaattcgtcaaggaagttggagcaaaagctgcaagtataattgcatcctatcttgaagaaacagttttagattaaactattgatagactaagttcatcgtaacttagtctatttttatgttaaaataaaagagccacttccgaaatgtaaggaaagtaaagaggttataagataatatgactaggaaaaatgtatacttagataacgcggcaactacgccaatggatccaaaagttattgaaaaaattagtagtgaaatggctgatgattttggcaacgcttctagtcaacacgcatttggtcgtaaggcacgtcatgtagttgaaacagctcgtcatcaactagcagaaacaattaatgcccaagataaagaaataatttttactagtggtggctcagaaagcaataatactgctatttttggtacagtacgtgctagaaaagatattggtaaaaaaattattactactaaaattgagcatccttctgtcttaaatcctatgaaacgcttagctcaggaaggatacgaaattgtctatcttgatgtcgatgaaactggccatattaatttagacgacttgaagagagaactaacaccagatacaatcttagtttctattatggcagttaataatgaagttggatcaattatgccgttaaaagaaattggtgaattagtaaaagattctaatgcatattttcatgtagacgacgtacaaggcttcggaaatattgaaattgatgttaaagaaatgaacatcgacttattatcaacttctgctcataaagttaatggaccaaagtttttaggttttctttatgaaaaaaatggtctaaaagtaagtaatttacttttaggaggcgaacaggaaactaaacgccgtcccgggacggaaaatgtaccaggtattgccggctttggtatagctgctcaagaactaaatgaaatggataagcagaagctgcaagagaaataccaaaactttcaaaaaataattctggatgaacttgataaaaatcaaattgattatgaagtcaatggaactcttgaaggcaaagtatctcaccatgttttgaacttatggctaaaaggtgtaggtacttactctgccttaactaatttagacttaagtggatatgctgtttctggtgggtctgcatgtacggcaggttctcttactccttcacatgtcttacaggcaatgtatggggaagattcaccaagaattgaggaatcaattagaattagctttggtagatttaatactgaagaagaaattcaagaatttgcagcagatttagttaagatgtgcaagcgtctagataaatagtaaaattatttttttgagaatttgtcttaaggtataataatagtaaaatcatatacttgacacttacaaaaaataagataataatattgagagtgatatttttatggcaaatacagtaattattaacggcgataatcgtaaatttacgattaatcctgaaattaagcgttatgcattgattgatgcaggtttcacaaaaactaaaagaggtaattttatgtataagcatcccttatataatgagtccccttataatgctacctgtcaattaaagctaacaattaatgaagatttagatcatttaacaatggtagttacagatactaatggtttgcaaaaggttaatatttttaagaataaacaactagcgccaatggttgaactgcttaacttcattttaaaggatcttgaagatcgccaaattattgcaccttgctaaaaggagaaaaagataaaatggtagataacagcaaaattagagtcgttgttggtatgagtggtggagttgattcttcagtttctgcacttttactcaaacaacaaggctttgatgttgtcggcgtcttcatgaagaattgggatgatactgatgattccggagtttgtacggcaactgaggattacgaagatgtaaaaaaagttgcagatgaaatcggtattccttactattctattaactttgaaaaggattactgggagcgcgtatttgaatatttcttggatgaatataaaaagggcagaactccaaatcctgatgtaatgtgtaataaagaaataaaatttaaatctttcttagatttcgcaatggatttagatgcggattatattgcaatgggtcactatgcagcaaccagagttgacgacaacggtgttgttcatatgatgcgtccaaaggatggcaataaggatcaaacttactttttaagccaactttcacaagatcaattgaagaaggtaattttcccacttgctaatttaactaagccacaagtacgtgaaattgctattgcttcaggattagcaactgctaaaaagaaagattcgacaggaatttgtttcattggtgaacgtaactttaaaaaattcttgagtgaatttttaccagctcaatcaggaaaaatggttactccagatggaaaagttgttggtgagcacgctggtttaatgtactacactattggtcaaagatccggccttggtttaggttcaactaaggaatcaactgatccatggtttgtagtaggtaaggacctaaagaagaacgagctaattgttgaacaaggttatgacagtaagcttttatatgctactagcttagatgcaagcggtgtatcattctttacaggccaaccagatcacgacgttgatttgaagtgtactgctaagtttagataccgccaacctgatgttggtgtaactatgcactaccgtgcaaaggataatacagttcatgttgagtttgatgagccagcacgtgctgttactcctggacaagctattgtgttctacaatggtgaagagtgcttaggtggagctacaattgaccgtgcataccaaaatgaaaagcaattacaactagtatagtttagaagaagtctcttttgaggcttcttttttatttttataaactgttattttctcctcttaaaacttataatagtaataaaagtggagggaaaagcaaattatgcaattatattttgtaagacatggaaaaacaaaatggaacttagaaggacgctatcaaggtggtagtggtaattcacctcttttgcctgaaagttacgaagatatcaaaaaattagctggatacttaaaaggaacaaagtttagagctttttattctagtcctttacagcgcgcattaacaactgcagtaatgcttagagatgatatgggaattactgtcccagtcattattgacgaccgtttaaaggagttcaatttaggggatctggaaggaatgaaatttgttgatgctgaaagtaaatatccagatcaaataaaagcatttcggtattttcctgatcgttatgatccatcaactttccatggtgaaaattttgaccatatgataaaacgtggaaagaaattgattgctgatattgtaaaaagatatcctaacaaggatgataaagtattattagtaagtcatggagctgctttgtgtgccttaattagaactctagaggggtacgatattgccgatattagaaagcgtggcggcttaactaatacaagtcttacaattcttgatacggaagataatggaaagacttttgatgaagtagcgtggaatgaaacaagctacctagatcgaaaaattactagtagggatacaatttaaaatggataaaaagatagccaacttatatgatactggcaacgtagataaagctatacatttattaattgaaaagataaacaaacatccccaggatattgagaattatttgcagctttcaacttatttaattgaacaaaatgctgctgatcaggcgctagaactgttagaaaaagctcgtggccttgttaagcatcctgaagatctaacctataacattgctgtctgctactacatgcaaggagattttgccaagtcgcttacgttgcttaactccattgcagatgatgaagagacaatgtatcaaaaagctttgatctttatgaaattagggcagtatcaaaaggcactagcctatgccttaactttaaagaatcaggatgagcgaactttagaattaattggtgatatttggcttagtttgggtgatttaaaatctgcaaatcaaacttataataaaatttcagaagaccaaagaaatgcaaaagttaattttttattggggttaactttatttgatactaatcctgatgaagcagaaaaatattttaaattatcaaaaaatcaagatcccaaatattttgctcaagcacaaaagcaatataatgcggtagcaaaattgattagaggtaaaaatggcagaaactagttttactggacgaataaatggaattgtttttgaaaacaatcaagatcttttcaagattattgatgtagatttaatcagtaaattacctgattacgatcgtgataatatccgagtaactggaaattttggggatatccaaattggatcaacttataaatttaccggtaatattgtcgtgcacgaaaaatttggtaaacaatttcgtataaggtcttatgaaccagttttgcctcatgaagagggtagtttagctaaataccttagttctgataagtttcctggaatcggtaagagggctgctgaaaagatcattgatagtttaggaaccaatgcgttagatttgattaagtcaaatccaactgaaattgacaatcttgatttaactcaaaagcaaaaagatagcttattatctggaattaatcagatggattctttttcagagattgtgattaagctggctagatatgggattaacaaaaaagtagctggtaatatttataaagtatatcatggtgattccttgaagaaattagaggaagacccttatcaagctcttggtgaagttcgcggctttggttttaaaactgcagacaatatgggacacgcgctcggaatagaactaaatgatcctagaagagttaggggagcacttctaagtattttacagactgctcttaataccttgggagatacttatgttgcacttgatgaattattaacacaggcttatgatttagttcaatctacctcttatgatgagcttgctaatagtgttaatgaacttcaaaggcaaggaaaagttgttgtttcaggtgataaggcagctttgcagacaatttttcaaactgaacttgatatagccactgaattaaaacatgtagttaataatcaagtcgaaaaagaagaatttgatgatagcgatattgaaaaagcaataaagcatgtcgaagaaacacttgaaattgaatatgatgatactcaaaaaaatgcaattaaaaatgcgttaaataatccaatttcaattcttactggtggtcctggtactggtaaaacgacaattattaatggaattttaatgtgtttaaaggaacttgcggaaattccaagtgcagctttgtatagcgatgatccaccatttttacttgctgcaccaacgggtcgagctgccaagcgaatgagtgaggttacagatatttcagcgaaaaccattcaccgtttattagggttaggcatcggtgaaaatgaagcgactgatgtaaacgaattaaacggtgagatcttaattattgatgaaatgtcgatggttgatatgtttctctttaaacagcttttatccggtattaattcaacaaagaggatagtttttgtgggggacaaagatcagcttccttcagttggagcgggtaatattttcagcgatttaataagttcaggggcatttccaactacaaagttgcaagtaattcatagacagggagaagactcctcaattattaagttggcccatgcaattaatgatgaagaagcagaagagactatttttaataaaactaaaaattactcctttattccatgtcaaccaagcttggtgggggatgcaatcgatcaaatcgtaaatttggctattaaacgtggtttcaaaaaggatgatattcaagttctgggagcgatgtacaacggtcaaggtggaattactcacttgaatgatattttgcaggatgtgatgaatccactatcagcaaaaactaaagtaattgaagctcacaatgaaagttttagaatcggggaccgaatcctacaattacaaaataatccagaaaaagatatttataatggtcaaattggtaaaattattggccttaatcctgatgataaagccaaaatattaattgctgattttgacggtcgtgaaatagaatttggtattaaagacttaaatgatattacccgtgcgtatgccattaccatccataagtcccaaggatcagaatttccgttagtaattttaaatcttacgatgcaaaattatatgatgttgaggcggaatttgttatataccgccattactcgtgctgagaagaatttagttatggtaggagaaaaaaaggcgtatattatggcattgcgtactccaggtaatgaccgtaagactgagttagcagctaaaattaggtatgagttaggtctaaaagaagttgaaaatacttcaaatgtaaatgcggaacaagaaaaaaacaaagctgaacttaaagaagaaaatgttgagccagaaaattatattttgactcctgagctaatttattctggacagattgatccaatgattggaatggaagatattagattagaagaaaaaagatagcaaaatagccagctcattatgagctggctatttgtcgtttattgcaaaagatcaaaatgatccacttcaaattttagatgaaactttctttttgataattcttctccatctaactgaccatactcaggatcatcagttttaacttcaattgcagatgattcaaaataatgaaattggttacttttcatgtgtgatccattaattagcaacttagaaaataggtaaataaattttactaagtttggcttttctacaattgcaatatctaagtgatgattgtgaatgctagcaatcggtaagattggtacgccgccaccgaagtagggatggttagtagtagtaactaaataggcgtgttcatagtaagaggtatgaccattggttgaaactctgaccttaaaattgtcttgtcccttgagcgcttgaacaatattaattccgtaagttaagttacctatattaattttattaaatttagtttttagttttgagtggttcgttttattaactacataagcatcaaaaccaattcctaaattgttaacaaagtatcttgtctcaccgttaattagatcatggtattttccgcaatctactttagtaacggtcggattattttttagatgtctaatcaattttagaagatctgtttcaagtttagctgctctagcaaaatcatttccagtgcctgctgggaagtaggcaaggggagtgttaggctgctctgaatttttaacaccatttaaagcttggtttagagaaccatcgccaccgactacaataacatattcatttctagaactaatctcattggctaccttggttgcaattggaaccaattgtcccggataattggagatatgaatgtcatagtccattttttcatttttaagtacagtttcaatttgcttgagagctttttcgcctctattgctccctgattttagatttaccagtaaatgaatctttttcattattttttgcctatgtaatataaaaataagccccgagatggggcttactttatttcttttcaattagcattggcagaatcattggtcttctttcagtctttgaatataggaaatcttgaagattctcaataattgcctttctaatttcattttcttttggttgtggatctttcgccatttctgtcttaagaacatggtagacatgtttctgagcttgactaatcaattctgttgattcacgcatgtagacaaaaccacgactcaaaatgtctggacctgcaagaacgcgttggtgtttgtagtcaacagttgctactactactacaagcccttcctcagccaagatttggcggtcacgaacaacgatattaccaacatcatcgctaccagaagtatcaacaaagacatctggtatattaatgtgaccagcaattctagaagaatctctcgtcaaagcaaggacatccccatttttaagaacaaaagtatgatctttaggcataccagtagattgagcagtttccgtatgaactacttgcattctatattcaccatgaactggaatgaagtattcaggtttagttaactcaatcatcattttttgttcttcttgtccagcgtgtccagaagtatggacattatgaatcttaccatgaacaacattagcaccagcttcagttaacttattaattaggtggttaacgctagtagtgttacctggaattggattagaagaaaagatgactgtgtcgcctggttgtagtgaaatctgacggtgagttccatctgcaattcttgaaagagcagcaagaggttcaccttgagaaccagtacataagatcattgccttttcaggtggagtatggttaatttcattagcatcaactaaggttccttcaggaatatctaagtagccaagatcaataccattttgaaccccattttccattgaacgaccaaagatagctacttttcttccggtatcaacagcagctttgatcgcagttgatacacggtaaagattggaagcaaaagtggcaaaaataattctgcctttaattccagtaatgatgtcgtgtaatgaatgagcaacaaatctttctgactttgtaaatgtaggaacctctgcattagtggagtcagataaaagtgctaagacgccttcttttccgagtttagccatctcttggaaatcaggagctggttgattcataactggagttaagtcaaatttaaagtctccagtaaatagaacggctccttcaggagtatgaactgcaattcctagagtatcaggaattgagtgagttgttctgaagaaacttactgataacttatcaaattttaaaacagtatcttcatgttcttcatgaagttcactagagtttaaaattccatgttcatcaagttttcctcgaattaaggctaaagcaaatggagtagcatagacaggaatttcaggaattttctttaaaaggtaaggaattcccccgatatggtcttcatgtccgtgcgtaacaactaatgctttgattttttttctattcttaactaagtaggaatagtctgagataacataattaattcccatcatatcgtcttcagggaatttgataccgcagtccatgatgataatttcatcttggtactcaacgcagtacatattacggccgatttcgcctagaccccctatagcgtaaacgccgacttcgttattctttaatttcaaggtcgttagttatccttagaatcaaaagttgtcagtttgaaatctgggctttgcttttcgtaagcaagggagtttccagttaattcttggatgagttcaatgttgtagggggtgttatcctcaaccatagttcttgctgcaactacattatctgcttctaaaaaaagagtcttagtagtttctcttcttggattaacgatctggtctttttggtataaaactttgtagatcatttcttataatctccttatatttaaaacgttcaaaaaaacttctgcataaacttgcagaaattcatagctattaaaattttatcataaacttgcttttaagtataccaatttacttcatatatagtatggaaaaaggcgatagaacatcttgctctaacgcctagtagaaaattaaaagtttaattttaagaaattacgattgtatcttctgctaattcaaaaggattttgcttattgatgcgatcatagaataaatgaccatttaagtgatcaatttcgtgggaagcaacgattgctggatagtcttttaagcgaatagttttttcttcaccatctactgtatagtaacgaatttttaatttatcaggacgaggaacatatccttcaatgtctttgtctacacttaaacagccttcaccttcagcaagacaagttcttctaactgattcagaaagaattttaggattaacaaaaacttccttaaagatgatttcacctttgtcgtttggaactaaaagagcagccatttgaacactttcaccaacttgtggagcagccaaaccaacaccagctcttaattgatgcttttcagcaatcttaggatcttgggagttgattaagtattgcatcatgtcgtcagctaattttttgtattcatcggataatggaaaagttaaaggcttagcaacttgtcttaaaactggattgccatcgcgcgtaatatcatgcattaaaatcaaaattatatctccttaattaaataatttgctataaactataataacaattgaaagaaaagacggcaacgaccgaagtttttggtataatatttttgttaaaaataaacagttcacagcttgtacttccgttgacgacattatatttttagagtagaattgtaaaacgaaactatagagatataaagcttcaataactgcattattatttttgcgtaaaagggctgtgactggagtcacagtttttttatgaagttcggggaggaatttcttttgcaaagaagagacgatattagaaatattgccattatcgcacacgttgaccacggtaagactactttggttaaccaattgttaaaacaatcagatacattgccagagcacatgaatctagaagatcgtgctatggactccaatgctattgaacgtgaacgtggtattactatcttatctaagaacactgctgttaagtacggtgatactactattaacatcttggatacaccaggacacgctgacttcggtggtgaagtagaacgtatcatgcacatggttgacggatgtttattgcttgttgatgcttacgaaggtactatgccacaaactcgttttgtgcttaagaaggctttggaagctggcgttaagccaatcgtagttattaataagattgaccgtccaggtgctcgtccaaaggaagtattggatgaagttcttgaattattcatcgaattaggtgctagtgatgaacaacttgatttcccagttgtttacgcatctgctttaaacggtacttcttcatacgaatcagacccagctaagcaagaagaaacaatggatcctatttttgatactattgttaagaacattcctgctccagttgataattctgatgaaccattacaattccaaatcactatgcttgattgggatgactacgtaggtcgtatcggtgtaggacgtatttaccgcggaaaagttaaagttggtgacaacattactgttatgaaacgtgatggttcaactcaaaacttccgtgttactaaattatttggttacttcggtttgaagcgtaacgaaattcaagaagcaaaagccggcgatatcattgctatttctggtattaatgatatttatgttggtgaaactattgcttctgctgacaagcctgaagcattaccacttcttaagattgatccaccaactcttcaaatggactttgttgcaaacgattcaccatttgctggtcgtgaaggtgatcaagttacacctaagaaacttgaagaccgtttaattcgtcaaactcgtactgatgtttctttaaaggttgaaccaactgaccaattaaatgcctggactgtttctggtcgtggtgaattacacttgtcaattttagttgaagaacttcgtcgtgaaggatttgaattacaactttcacgtcctaaagttatttaccgtgaagttgatggacaaatgtgtgaaccatttgaagcagttcaagtagatactccagatgcttatgtaggttctgttattgactctctttcacaaagaaaaggtgaaatgaagaatatggaatctactggtaacggccaaactagacttgaattcttagtaccatcacgtggtttgattggttacaacaatgaattcatgtcccaaactgctggttacggaattatgaaccatacttttgattcatacaagcctgttgttaagaactgggaaccaggtcgtcgtaacggtgccttagtttcaatcaatcaaggtcaatcaacaacttactcacttcaatcagttgaacaacgtggtgaattattcatcggtgctggtgttgaagtttacgaaggtatgattgttggtcaatcatcacgtgaacgtgatattgctgttaacgtaactaagggtaagaacttaactaacactcgtgctgcaggtaaggaccactcagcttcaattaagactcctaagactatgactttggaagaagctattgaattcttgaacgatgatgaatactgtgaagtaactccagaaagtattcgtttacgtaagaagatcttaaacactaacgaaagaaaaaaggcagataagaaacgtaacaaatagtttatttcttatttaatttttaaaagtagctcaatttattgagctactttttttgttatgcagaggtagtgatataataagaaagattatttaactaaaggggcagatatattgtgcgacaaaaactaagatacttagactatagcatcttgatcccatatcttgttttgtcaactatcggggttattatggtctattcagcaagctcggacattttattagtaaatggtttttcaccgagtgtatatatgaaaagacagattatatatttcttggcagcatttatagcctttggaattccttgttttgctttaaaattaagagtattcaaaaacagaaaatttgttatgtcctacttaggaatttcatttttgatgttaatgtttttaatcgttcttaaaattgttagtcatggaaaagctgctgttaatggtgctgttggttggattaatttaggatttattaatattcagccagtggaagtagctaaattatctctagttctttatttggcttttgtcttgtcgagacgagatggaaagtttgttccgggacaaatctggcataatttatttgggccaactgtaatttcatttttgatgattggtttggtaattttagagcctgactttggtggttcagcaattctatttatgattgtttttgtcatgtatagtgtctcaggaatccccacaagattagccgtttattggttagtaggattactgctaggaattgttttattgatggcaattttattgttttggaccccaggattcatcaaagattcctatcaatttcagcgcttgctcgcttttgcccatccctttaagctagaaaaaacaggtggtgcacagctggtaaactcctattatgcaattcataatggtggtttgtttggtgttggattaggtaatagtatgcaaaagagaggctacttacctgaaccatatactgatttcattttatctattaccgctgaagagttaggagtaattggcgccattgtgattattaccttattattctttttaatgtggcgcattatggaagtaggaattcatgccgattcacaatttaatgctttagtttgtttcggggttgtaaccatgatttttacagaaacgctctttaatgtaggggcagttttaggattattgccaattactggggtaaccttaccatttatttcttatgggggatcatcaatgattgtgctaactgctgctttaggtttagtcttaaatatttcagctgctgaaaagaaagcattagtagaaagtaggagtgtactttgagtttggtttttaaggatgagtcaaatgaaaaaatgactccccgtacgcagataattgtttggctgaatcaaattagcgatcagtataagttgcgtagatttggtaatattatttatttttcacgtaaaaataagtatgtgattttatatgtcagttcacaatacgcagctaagacaattgcagagctcagaagcaaaagttatgtacagtctgtggaaacatcaaaaactgatgagcttgatttctctgctgaacacgaggaaaaaatgatgcgggaactaaaagaagaagcagaaaaattacgagaagaaaacgaggatttacgagtttgagaattattgcaggaaaatatgctaagcgtaatttgcatacattgaagagtaatgccactcgaccaactagcgataaggtaaaagggtctttatttaattctttggggcaattttttgatggcggtcaagtactcgatctatatgccggcagtggtgccttaggaattgaagctgtttctcgtggctatgatgaggctgttttagtagatattagtggtcaggcatgccaggttatcaaaaaaaatgttgaactcaccaaggaagaagaaagattcagagtcttaaagtgtagtgataatcgcgcaattaaaattttgcaggatgagggtaagaaatttgatcttatttttcttgacccaccttatgctaaacaaaaaattgtaaagattatgacgaaattgcttgagaataacctattaaatgagaaggcgcttgttgtagcggagacagatgaacatgatgaattaccagaggtttctggcttttcaattattaaggatcatcagttaggacgaacaaaggtaaaggtttacgaaagagattaaaatgataaaggcgatttttcccggaagttttgacccaataactaatggacatgttgaggtgattgaaggtgcatctcatatgtttgaaaaattatatgtagtaattatgaccaatactagtaaaaagtatctttttactgaaaaagaacgtttagaattggcgagaaaagtttttgaaaacaacgaaaaagttgaagttattgctcgaccagccgagttaaccgtggaagtagcacatgaacttggtgcaggcgcaattgttcgtggattgcgaaatacagctgattttaactacgagcgtgatatagctggaatcaataagaccttagatccagatttaaatacagttttattgtttactcgcccagaagatagctttatttcttctagtatgattaaagaaactgtattttttggtggggatgtttcaaccttagttccaaaaccagtcgcagctgcattggaagaaaaattgaggaatagaaataatgaaaaaaaatagaaaattaaagttttggctgctaggaatagcagcatttttaatagcagttgtattttgtctgtggccaacgcaatattatattgaagctcctggtgaagcttttcagattagtaaatatgtaaaaagtactagaaaggctaatcctgatttttatttggtaactgtaagcgaacgaccggcggtaatgattgattatttgacaagttttttgaggccggcagatagtcgctactcaaaggatgaattaatgggaacatcgactagtgcagaatataaccaaatgcagcagtattacatggaaactagtcaaaataatgctatttactatgcggctaagaaggcaaatgttccgcatcgtcaagagttcttaggcgtttacgtaatggaaataatgagtaattcgaccttcaagaacaaattgaaggtaggagatgtattagttagcgtaaatggtaagaaattcaattctagtcaagaattaattaaatatgtttcttctttaaagaagagtaaggtaagaattgaagttattagagggaagagacatctaactttctccggtgaaacggtaaaactttctggaactaaccgttacggaatcggtattcaacttgtagatcatacgcgggtagtaacaaagcctgcagtaaaaattgatgcggaagatattggtggcccttcagctggattaatgtttacgctcgaatgttatcaattatttaccggaaaaaatcttagttctaaaaagatagcagggactgggacgattgatgatcaaggaaaagtaggaatgattggcggcgttgataagaaagtaatagcagctagtcgacagggaatgaaagtcttctttgctccaactgatcaaccatcgggagttaaaaagagtgaaacgaactatgcagaagcggtaaaaactgctaagaaaattcatactaaaatgaagattgtacccgtagctcgatttgaagatgcactaaattatttagaaaaataagaaaaagcagcaaaaaattgctgctttttttcgtaataaataatgaggtgataaaaatggattttgaaaaaataaaagacttcatcttaggaaagaaaggactagtaattggaattattgcgacgattttaattggtggatattttattcaaaaaaataatcagccggtagttaataataatcaagttttaagtgaaaataataagaaccaatcaacagatttttctaaaaataaaagtaataacactccttctgctactggcgttaatagtccatctaaacaaaatactgtaactgtagatattgctggagctgttaaacatagtggagtttatactttaaaaaatggggcacgcttaaatgatttattaaaagtatgtggcggcttaaccgataaggcagagacaagagcaataaatcgagcagctcttttaaaggatcaagatcaaatttatgtcccccacattggtgaaaaaatagagaatgtaccagcagtcggaaatacaactactaactcatctgcttcagattctgctagttcaaattctgagcaggtccatttaaattctgcaacagttgaagatttacaaaaattaaacggagtgggtcagaagaaggcagaacaaattattgcgtatcgcgatcaaaatggaggtttcaaacaaattgaagatttaactaaagtgacaggaattggtgaaaagacttttgaaaagcttaaagatcaattggctctctagtttttatgctcccggattctatttattacttagtttgggaggtatttcagttacttttctaattttgcagactactacttttgcccaaagaattgtagctgtaatttttttgctttttttctgcttcttgctcatttataaatttcctcagtatcgacaattactggttttgtttttaggaataatatctcttataactttacttaatcagcaaacaagtgaaacgaaaattggagaaccaattcaaatatatagtgatcaggtgaaggtgagtgaccaatttttctatggggagggaagaattggaaagaataaagttttaattagtggaagtataaacaagtcacttgaaaaagaattaaatcgctttgggggatgttatttagtaaactacaaggcaaaagtagaacaaattatgccagcaactaacccaggtgaatttgactaccaaaagtattatcgtagtaaaaaaataagggagagagtgaaacttgaaagctatgagctttatcctaagaaaattactatttttgattggatccatattttacgtaagtggctgatcgattattttgaaaaaatgccccagtttacaagattttttgccagtgaaatggttctagcacaaaatcctagtccagaaaataaggttttactcaatagttatcgtgacttaggaattatccatttgttaagtatctctgggctacacgtaagtttatatattctagggatcatgtggcttggaacaattatgaaaagaacagaagaagagttaacgattttttgtgttctttttttaataattgaaatcttactttctaattttcaggctggttttgtgcgggcaagtttaagctacttttggaatgtattctttaaaagaaaaaaaggttatgattagtagcggagataaattaggaatagtagcgttaactcatctcctatttaatccgctattatttttaaatagtggggcgattttaagttatttgttagtctttggattagaaataagcaaagattttaaaaaaattaaacaaaatatagttcttaatttattaattacgccaattctattacataatttttatcggattaactttctaactatcatttataatttcttgattgttccaatttttaattttattcttttgcctttaacctttattgtgatttttatattttggtgtttaccagatattgtcagaataagtgaaccaatttttaaagtcattgcggacttaactaattttattgctgataagcaggtgggattaataacttttgggcaaataaattggtttcaaactatatttttattggctgtgactttgtttttgattattatgcctaagaataaagtaaagaaattaaaattaagagtaattttgcttggggcatatactagctttttctgtttgattcattttccacttaaggggcaagtttcttttattgacgtaggacagggggatagcattttaattacgacgcccttaaatagaaaaacatacttaatagatacaggtggaaaactaaattttggtaaaagaaaaagtgagccgcagttaaatcggatcactataccatttttatatgcacagggaattgatcatcttgatggagtctttttaagtcatcaggatgcagatcatatcggtgatttaaaagctttactggatcaaattccagtaaagcatctatattttgctagaggtttgactgataatcagtcttttatgaagaaaataagtaatcatttaaatgatgtgcaactgatgccacttcttgcaggggataaagttagagaaggcgggatcgactttgacgtggtttatccttttaaagcgggcttaggtaagaatgaagattctttatctataacgtttaaggtagcgaataaacgttggctttttaccggagacttgggtagagaaggagaaaaagagatacaaaatcactataatttccaagttgattactttaaattaggccatcatggtagtaaaacttctagcgatccagattttttaaagcatttaaatccacgtctagtctttatttcttcaggacgcaataatcgttttggacatccccatcaagaaactttaaaaacattgaaagacttaggtattccatatttaaatacgcaagatagtggtacaattacttggaattactcaccatttcaaggtgataagattacgactttttataaaggaaatacaaaatgacattaatctctctttttaaacagactaatcctaagaatgctaatcttttgattcaaggaccagattcattttttaatgattatttggttcgcaactacctcaatcaaaaatctttttctgaacttgatcaagtgattgtagactgccttgaagatggacttgatgaattaatggcaactttaaccgagtcttctttattcagtaaccagaaagttgtggttgtgaagaatcctttctttttaatggctaaagtaccacaaaagtttaaaaaacaagttgaaaaattaactaaaatcattgaacatttgagtgatttagaagatgtagttgtttttgtggctaattatgaaaaaattgatcgtagaaaaaagattagtaaacttttgcttgaacatgttaatgtggttgaaactacgtttaaaccctatgaagttagtggaataattaaggccataagtaaagaagagaggtatcaaattactaatatggcgcttcaaatattgatccaaagaagtgaccaagttctagacgtctcattaagtaactatgtaaaattaaaaaatattgttggtgaagataaaaggatcacggaaacactaattaatgaaaatattgatcgttctctttcagaaaatatttttgaaatattaacagctgcttttgataaaaaatatcaagaggctactcaacgtttagaggatcatttacgagaaggggcaagtgcaattcagctactagctatttttgaatctcaacttgaatttttgacttgtgttaaagttttgcagaatagacggtggagtaaagatcaaattactaaagagttaaaagtgaatccgtatcgagtaaaattagcccttgaaaataaagtctcattaagtaaattaacagtgttgttaaagcaggcgattgaacttgattttggctacaaaaacggaacttatcatggggatgagtttttgaagctctttctattaaaaatttagacaacaaaaaagctcggaggaaaactccgagcttttattttgcctaatatcaggtgtcaagtaaataattacttgttagcagccttcttagataagcgtgacttatcacggttagctttgttcttagaaataagacctttagaagcagccttatctaaagcacgtgcagctttaacttctaaatcgaggacatcttttgcgtcattttcaacagcttcgttgaattttcttacagcagttctcaatttacttaattcagcagcgttgcgcttgttagcagtagcattagtcttaacacgtttaattgctgatttaatttgtggcatcaaaatcacctcgataaaatagatttactcgttaattatacttaatacaagccgttggtgcaaggtaatttggacttgcttttttaaaaacttccatgtaatattaatatctgttggaaccattgacgctgttttcccgccgccgacggttaacgttgttaatggcaattatttaaaagagaggtatttttctaatggctatttcaaaagaaaagaaagatgaattaatcaaagaatacgcacgtcacgatggcgatactggttctccagaagttcaaattgcacttttaactagtgatatcaacaacttgaacgaccacttaaaggctaacaagcaagaccaccactcatacgttggtttgcttaagaagattggtcaccgtcgtaacttacttcgttacttgaagaacaaagatattcaacgttaccgtgaattaatcaacaagttaggtttacgtcgttaattctaataattcataaacctcagctactctttatcttaaagagtagcttttttgttcctttcaaattcatactattatatggtaaaattaattagattaacttcgttttgatcattaagatccataaataatttaagtaaatatagaaagaagcaaaaaaatgtcacaaaagattaagataatgatcttgggtggcgcacgtgaaaatggtaaaaacatgtacgctgttcaagtagaagacgaaatttttattatggatgcgggtttgaagtatcctgattcatctttattaggaattgacgttgttattcctgacctacaatttttccaagattatgccgataaaattgcaggtatctttttaactcatggtcatgctgactcaatcggtgctcttccatatattttaagagatcacgatattccagtttttggttcaaaattaactattgaattggctaagatcgctgttcaacgtgaaaatagacgtcgtaaaaatgacttgttccatgttattgacgctgatacagaaattgaatttaaaaatgcaaatgtctctttcttcaagactacgcactcaattccagattctttaggaattgatatttccactaaagaaggagagattgtctacactggtgactttaagtttgatccatcagctaaaaaaggttatcgaactgattttgttcgtttatctgaaattgcccaaaagggcgtcctcgcacttcttagtgactccactaatgctgaagctaacttcccaaatgatcgtcagactagtattgaaaaatatatttacaatatttttgagaattatgatggtcgaatcattgctgcagcaaaagcatcaaatatcgtccgtgttcaagagattttccaagcagcggctgccactggaagacatgttttcttgacaggtagagatgctggtaagattgtctatacagcaatgaaattaggttacttaaacgtacctaaaggattacttgttcacagtaaggacttaaagaagattcctgacaatgaattagtaatcttagaaactggtcggatgggtgaaccacttaaatcccttcaaaagatggcaactaaccgtcaccgtatgattaagattaagaagggtgatttagttttcattgctaccactccttcacactctgttgaaactatggttgcccagactagcgatatgatttaccgtgctggcggaacagttaaagaacttggtagagacaagcatacaagtggccatgcaactgggcgggacttgcaaatgttaattgatacacttaagcctaagttcttaattccagttattggcgaataccgtcttcttgaaattcataaagacttagccattgaagcgggtatgaataagaaagatattttcttaccacataacggggatgcatatgctttagaaaaaggacgtttctatcgtacagatgcggttcctggtgaagatatcatgattgacggttctggtgtcggggatgttggaaacatcgttttaagagaccgggaagttctatctgatgacggtgtcttcattgctgcagttactattgacagaaagaaaaagaagatcatctcggaaccacgtgtttcaactagaggatttgtatacattaaggctaaccatgccttgatgaatggcgctgctgatgtaattaaagaagcagtaaacaataactttgaacataagaaatttgattggactgaattaaagcaagatgttcgtaatgatgttgaaaaatatctttacaagcaaacaggacgtcgtccagttgttttaccagttgtaatggaagttaaccaaaatagacaccgtgcaatggctagacgaaacaaccaagaaaataattctgagaaacgtccagttagaaaaaatcatcataaaaaagattcagaacaaaagaaggcaaaagcttaatgtcacatgcaagtcaagataactttcttcttttagcaaaagaggctaaaaagcacaatgatttaccgcaagctaagcaatatttacttgaagctttacggttaggtcatgattcagatattgtttgtgagctatgtgaaatatatttaagccaagagaagggagatcaggcatattctttgattaaggaagagcctgaccttttttctaatcaaagagtatatgatacttatcttaaaattttagcttttcagcattatgcaattgaagcggctgagcttgagtacttactgcaaaaaaagctaccagtaaaaattgaaccggttagtcaaattaagcagttagaaataatgaaaaattttaaacagcttaaatatattcaagaaaaagattatttacttttatattgcttaagtacagaaaactttactaatttggcaaaaagtattttaatggatccatctcctaattttgctttgcgtttatccttatgtgaagatttagtaaaacttggatacaacgaaaaagttcaagtttacattttaggagaattaaaagaatttattcctaaagaaactgacttacttgaaaaaagtccaatttatcgtgaagtttgtgttagcttagcggattactttagacaggatccaagcaaactgccaataatgattggtgagatgaatgtttgtttagggatgctatatccgcgtttaaatgattatattagagatccggatcaatttgctcatgattttagaaattatcttgagcaaaagaagggcggagctaatcagaaacttttaaataaaatatatgaatatttggcatatgaaaaagcaacaaattctgatttttagtgccgatattgagcaaaaaaggtttacattttctgtggatctagtataatcaataaaggatattttcaaaggggtacgagctaggcttttacctttgaaagtagtataataatcaacagagaattatccgttacttactcaacggacttcttgcaaatttacaggagggtcatattaatggcagaaaaagaacattacgaaagaactaagccgcacgttaacattggtactatcggccacgttgaccatggtaagaccactttaactgcagctattactactgttttggcagaagacggtttggcacaagctgaagattactcacaaatcgatgctgctccagaagaaaaggaacgtggtattactattaataccgctcacgtagaatacgaaactaagaatcgtcactacgctcacatggatgctccaggtcacgctgactacatcaagaacatgattactggtgctgcacaaatggatggtgctatcttggttgttgctgcaactgatggtcctatgccacaaactcgtgaacacatcttacttgctcgtcaagttggtgttcaatacatcgttgtattcttaaacaaggttgacttagttgacgatccagaattgatcgacttagttgaaatggaagtacgtgacttgttatcagaatacgattaccctggtgacgatgttcctgttatccgtggttcagctttgaaggcacttgaaggtgatccagaacaacaagacgttatcagaaaattaatggaaactgttgacgaatacattccaactccagaacgtgatactgacaagccattcttaatgccagttgaagacgtatttactatcactggtcgtggtactgttgcttctggtcgtatcgaccgtggtactgttaaggtcggcgatgaagttgaaatcgttggtttaactgacaagattgaaaagtcaactgttactggtttggaaatgttccacaagactcttgaccttggtgaagccggcgataacgttggtgtattacttcgtggtatcgaccgtgatcaagttgaacgtggtcaagttttagctgcacctggttcaattcaaacccacaagaacttcaagggtcaagtttatatcttgaacaaagatgaaggtggtcgtcacactccattcttctcagattaccgtccacaattctacttccacactactgacgtaactggtaagattgaattgccagaaggtactgaaatggttatgcctggtgataacgttgaattcactgttgaattgatcaagccagttgccattgaaaagggtactaagtttactatccgtgaaggtggtaagactgttggtgctggtcaagttactgaaatccttgactaattccaaactttcttaaaaaagatgtatcttaggatacatcttttttttatacaaaaattaacaaatttctctctggatttgtgttttagcaaggtttagggtaagatagttaagtgtgcaatagcaaacccaaatttgacatcggaggtatttaattaatgtctgtaaaatgggaaaagaccggtaaaacatccggtgaattaacttttgaaatctcacaagaagaagtaaaaaagggcttagatcaagctttcaaacgtgttaagaagaacttacgtgtacctggtttccgtaaaggtcacgtttctcgtgttgtttttgatcaattttacggtgaagaagctctttacgaagatgctttaaacatcgttttaccagaagcttacactgctgctgttaaagaagctggtattgacccagttggccaaccacaaattactccagtttcaatggataagaacaagccttgggtaatgaaggctactgtttctgttaagccagaagttaagttaggtgactacaagggtattgaagttcctaagcaaaacactcgcgttttagttaaggacgtagatgcagaattaaacaagcgccgtgaacaaaatgctgaattagtattgaaagacggtaaggctgctaaaggcgatactgttactatcgactacactggtactattgatggtaagccatttgatggtggtagtgcacaaaactattcattagaattaggttctggtactttcattcctggttttgaagatcaacttattggtcacaaagctggcgatgatgtggatgttgttgtaaccttcccagaagattacggtgcaaaagacttagctggtaaagaagcacactttgctactaagattcatgaagtgaaatctaaagaattacctaagttagatgacgagtttgctaaagatgttgatgattcagtagaatcacttgatgaattaaaagataagatcaagaaagacttgaagaagcacaaggaagatgacgcaaaagacgctatccaagatgctgcaatcaagggtgcagttgaaaatgcaaccattgatgaagttcctcaagcaatgatcgacgaagatgttcaaaatcaattgaaccaatacttaggcaacatgcaacgtcaaggtattgacccacaaacttacttcaagttaaccggtactactgaagctcaattgcgtgaacaattagctaagggtgctgcagaacgtgttaagactaaccttgttttggaagcaatcgttgctaaagaaaaacttgacgcaactgctgatgaaattaagcaagaaatcaaagacttagcacacgactacaacatggacgaaaaagttgttcgtcgtagcttgagtgatgatatgcttaagcatgatattgctattagaaaagctattgatttagtagctgacaaggcaaagcaagttgctaagaaagctactaagaaatcaactgctaagaagtcaaccaaagaagacgacaaaaaggctgataaataatagttgataactagtttaagaaaagggcggctatgacagtcgcttttttctttactattaattaataagacaattttctttactctgttaaagtgaactgctaagcttattttgacataaagtaagtgaaaaggaggatggctgatggctaacgaaattactgagcaagaagaagtaaaatgttctttttgcggtaaaccacagtcacaagttaaaaaaattgtggctggaaatggagtctacatttgtaatgaatgtatcgatctttccaagaaaattattgatgatgaattaaaagcagattccattaaagaaactaaagatttacctaagccaatggaaattaaaaagcaattggatgagtacgtaattggtcaagatcgtgctaagaaggtgctttccgttgctgtttacaaccactacaaacgtatcagtcaaatggatattgatagcactggaactgagttgcaaaaatcaaacattgctttgattggaccaactggttctggtaaaacttatttagcccaaactttggctaagattttgaatgttccatttgctattgcggacgctactactttgaccgaagccggctatgttggtgaagatgtagaaaatattttgctcaaattgttgcaaaatgccgactatgatatagagcgtgcccaacgcggaatcatctacattgacgaaattgataagatttctaaaaaagcggaaaatgtttcaattactcgtgatgtttccggtgaaggtgtacaacagtccttacttaagatcttagaaggaactattgcttctgttcctcctcaaggcggacgtaaacacccgcaacaacaaatgattaagattgatactactaatatcttattcattgtcggtggtgcttttgatggtattgaaaatatcgttaaaaaccgtcttggtaagaaaacaattggttttggcgcagaaaatggtcttaaccaagtagatgcagatgactggcaaaagaatcttacaactggagatttagttaaattcggtttaattcctgaatttattggacgtattccaattattgctactcttgataagttgagtactgaggacttaattagaattttaactgaaccaaagaatgctttagtaaaacaatacaagaaattattgtcacttgacgatgtggaccttgaatttactgatggagccctacaagctattgcagatatggctattagtcgtcgtatgggtgcacgtggtttacgttctattgttgaaaattcattaatggatgtaatgtaccgcacaccaagtgatgataacatcaaagaagttcaaattactaaggatgttattactaagcatgcagagcctaagattacatataaagaggataaagctgaaaagacgagtgaggcgactaaataatgaaagtcgtagatgctgaatttgtcattagtgctgtttctgaaaaacagtatccgaaagatgatttaccagaatttgccttggctggccgttccaatgttggtaaatctagtttgattaatacgattgttaatcgccgtaaactagcccgtacatcccaacaaccaggtaagactcaaactcttaatttttataaggttaataatgagttgtatttggttgatgtaccaggttatggctatgcaaaagtttctaaaaagcaaagagctgcttttggggaaatgattcaagattatcttgaaacgcgtgctgatttaaagggattaattcttttagttgatgcacgtcacaatccaactgctgatgatatcaatatgtttaattatgctctctatctcgatattccaatcttggtggtagcaacgaagatggataagttgaaaaagatggaagcaagtcagattaagcaaaaaatcggcaagagtttggatctatcacaagaaaatgtatcttttttaccattctctagtgtttctaaattaaatgtagataaattctgggattgggtcgaagataagatgtaatttaaaaaaattgcataatttactgattaaattcatctatctttgatataattagatacgttgaaaatattgaactaataatgtttcaacaacctttgaaaaagaagaataccggttggagctgacaagctctagtcggtattttttcttgcctaaataaatgtattagctttagaattaaaatatacactttaaagaaataagggaaagaaatgactaaaaaaatcttatttatttgtcatggtaatatttgtcgttcacctatggctgaatttattactaaaaagattgttaaagatctaggtaaagaaaatgaatatgaaattgcgtctgctgctacaaccgaagatgcaattattagtgggatcggccatgatatcgatgtgcgttctcaaagagtaatgaatgagcatggaattccttttaaccatcgtcaggctagaaaaatggttaagagcgactatgagaaatatgactacattatagggatggatgaagaaaacttctttgatatgaatcatatttcagcaggagatccagaaagaaaagaatataaacttttatcttttgctggctctatgatggatgttgatgatccttggtacactggtgactttgaagcagcatatcaagatatttatcgaggctgtgaagctcttattaagaaaatcgagatgtctgataagtaatgcaagttttaccaatcttcctggttattttagcgatagtcgtatcaggatatatttttacttctaaacatcgtttttattttctgagagcgattattctgtttttagtattgttactgctaagtacaattaatttctcaatcttctttggatttgcggctctctttattgatcgaattcatgatatggaactagggaatctcttcttgctcctagcagccttggtaattttatcaggtcttctactatatgaaggcttaaagagatttaataaatatcatccaatttcagaaataactctaactttaattgaatattgtattcaatgggcattgatttatgttacagtttatcaatcgatcttcaataacattgctaagatccatacaattactaaaatgataaaaacagttcgtatcctcaatccggatttactagtagtaatcattttgccatcgtttatttcaatttggattgcggttgttttattgaagaaatatcaacacgatttataaaagatagtcttatggtaagactatctttttattatattaagactaaatttttgtcattatgcctttaagctcatacaataaaaagtgaaagcggattatatatgaaagaaggctttaattatgacagttccaacatttgatcgtgaaaaagaagctattatgaaagacgttcgtgaaatgattcaccgtaatcgtgacaatggctttattttagaagaattacaaaataaatacggtaaagacttttctgatgatgatttgaaggctttgattaaagaagctactaaataaccggaaagtaggcatactatgagaatgagtttttggatggattatgcatctccattttgttatattgcttttcataagctaactgaggcagttaaggcagtaagaattgatcaaaacaagttagattataactttcgcgcttttcaaattgatccaactgctactgaaaatccaacgcaaacgcggggagagaagttgatgcaaaaagatggtttaacccaaaagcaacttcatgagagatttcaaaatattactgaacaagctagagatgctggtttaacaattaattatgcaaatacacttccagtcaatacgatgaaggcattgcgtttaactaaatgggctaatgatacacaaagtaatcaaaagacagcccagttaattgacgcaatctttaaagcttattttgttgaaaatcaaaatattgctgataatgacgtcttagtaaaattagcaaaagacgctggattggatgactcatctgccaaaaagattcttacaagtgaagaatataaggacgtagttatcgaagatgaaaatgacttagccaatcgaaatgcggatgcagtaccatactttgaaattggccattatcatgatgaaggtgtgcctactaaagaagctctaattgaagcaatcaacaatttaatatatcagaaggcaaactagcctctattactaaatttcttctattcaaagtgtaatttcgcctaaaaagtgaaattacaccttttttattcaagattaaaaaggttctaaagttgaaatttaatggtaggataagaatggaagaaaaggagaatattatatgaagaaaatattattaatgagtgtgattgctctcagcttagtaggagcaagcggctgttcaaataactctaattcaactaataatagtagcgctaagagttcaaagactactcaaaaaaagcactgggataagaaaaaagatcaaaaactagctaaggaaatggataagtacggtaaaaagaagagccaaacctataccaaatatgatggtaaaaacaagctttctacttcagcaaatcgtgtttatccagatgcatttaagaaagatacttttaagttaaatggtaaaaagataagcattggctggagtccacaaggcgaacatcattatgattatgacgtcttggctatctataatcatgacttaactaaagatggacaacataagacttttctcttttgctggcacaagcaaaaaccaattgttttggtagatgagtctggtaagggaaatgttgttaacttacatgtcagtcaagacaagtcattaaatggtagcttttcaaacattatgtatggtgaaaatatctaacttaaggtctgcttctttgcagactttttgtttctaaaaataaatatccgtataatagatgaaaagtgagatgattggaataggtagggtataaaaatgttaagtaataaaatgaaagaactgcttgataaggtgtatgaaacaccaaatacaatggacctggcagtggtagtacagacaccggactttgaagaaacttttattagtgataatttacgccgctcttatcaaccagcgcgagctgaggggcttgtttttaggttaattgggactttcgttcaaagacttgatctagattattatgagttcattgatgtattaaagggcgatttagaaagtgacctatttaatgtccatgcgatgagaaagctcaagcgccctagtcaagagattactgatgataagcttaagcaactagaaacccgagtagaagatatcattgatttagctgaagaactagctagtgaaaaagagattggtgactatgtcttggtcgttaattatactgaccagttaggggatgttttcttccatgatactagcgatcaaaatatgtcgacttatcatgatattcaagtgatgctcatggaatatgcaaaccgcaatattcttaatcctttagctctaataaaagatttagaaaacaagcgtcctaatgaagctaaattactcaataaagctgcttttgaagatcgaaatattgatggcttcaatatagaagacttttggcaaatatatcgagctccttatcagggtggccaatttgatttagaaaatcctgaaggttatcgctttgaaaaagaactaattaaatatagtagaaacttgcaaaatttagatttgacatattttcttttacttgtgagaacagatcgctatgtttatgtattaaccccatcctttaagacagaagatgatctagtagaagccttagctggatatttaactagtctagaagtgaatatggactttacggatgaaaagtttaaagagatcagcgacatgatgctcgagagaaagtcttatcttgatttagctcatggaaaggattctgcgtatgcgattgacttaccagttaaacgagaagtggctgatgatcaagaaattcgaaaagaaattaatgacattttcagtgagctagtaacttatcaaaatatggatacagtccgtgacttttacatgtttgcaaatattaaagataataatttcactggtgggatgatgaaagacaataatttaacgagttacttactaaacttcgtcgaattattagcttatctaactcatatgtatccaaatctagcaccaaagaaaatagttgacttagttgcaactaaagaaaacctaaaacgtaagcgaaaatagttgctttatgcgagtaaagtttctattgtagaggtgagagtgtaataagagaaagaagagttgaaaaatgaaaatttcaatttggggcgattatgcatgtccttactgctacattggtgaaactaacttacaaaaggcaattgaagagttaggtgttcaagataagattgaatatgacttgaatgcttttcaaattgatttagatgcacctaagtcaactaagcaaactaatgcagtccttctagcttatgaaaaggctattccgttagctaaagcaaacgcagcctatgatcatgctaaggcaatgggtaaggcagttggtttaacaattaatgaagcaactgcttataatacaaataccatggatgctcaccggatggttcaatgggctaaggcaacttatcacgattctaagctaattgaaaatctagctgatgatttattctatgcttactttactgaaaataaggaattagcagaccataaagtattattagacgttgcaaagaagaataagctagataccgcagaagttaagaagatattagattcaaatgcatatcaagatgtagttatgcaagaagaagctgacttagaaagtcgcggagttgaatctgtaccatactttttaattaatggtcagcaatttgatggtgttcaagatgtttcaaccttcaaaactgtcattggagcaggctttgggatgaagccagatgaatttttaaacttctaaaaaagttatttaattaggtcctacacttttataggtgtaggaccttttttatatagtgattttttggtattattatattattgaataaaaaacgttatttaatagaaaaaggagatgacaatgaataataaactaaatctttttaacattggtttaccaactagtgaagacttaaatacttggtctaaagactgcattaagcaaaggttagatcacaatatcagtggcaatcttattccctttgtgtcagaagcaccagattatgaactaaatgagaatatggtagccttgtatgacttccatactaatccaatcaagaataaataccagtcggtaatttttgataaaaaagctggtattattttatgccaaaaaaatagccgccagctgattaaccatcttttaaagcacaagctgattttaggagcagttttacaaaagaaactacaaaaagaactgggcttttactaccgtcatacaatttctttaggagaaattgcctacttttcacttcgagcccattcagaaaagcatacttcttggattggcttgcatcatatgcagacggtacaacaagaaaatggtcgcgttactttttcctatcaagagaatggttatagttataactttgagtttgaagactgtgcgccgaatatgtataagcgattgggagaagcaattacccataatcatgttttaggacaaatgctagtaggctacgctaagtcgcatggttttcatctgaacttatgtaagtgcagaaagaatagtctagtagctaaccaagaatatttttacttaactaagattcaaaatgccttaaatttaactgaacttgctgaagaagcaattgaagaatttcatcgtaattatggtcgacactgtgctgacttctttgatatcaaagattggcagataaatgaccataatttgatttatcgattatctagacgaataaaatcaatcctgtagcacgcttgaaaaagcgtgctttttctttacaagaaatatggtgtgttagaggagaagatacaggaaagaaagaagtgaatgaaagatgaaaagttagaatttacaaggattgtggctagatagttcttggattttagaaaaattctgttcttgataatctaatacctgcacaagcgcttgtgacattacttaaaggaatggtcacatgattaaagaagagagttttattaaagcatgggaaaatcggcggctagtttgcggagcaattaaggctgctggtgtgaggaaagactatcaagagtatgcagatttggttcaggatggtgttttaatttatgcggggatgcttgagaagagtcaggaccacgatattgatcggcttgcctttaagaagattctttggcatacgttagatgaattaagaaaggttcaacgccgcgaagagagaagcgaagagataaataacgagcttgaatttaagaaggaaaaaattgaatgggataacttaataattttgaaagataaagtccaggaattaaatggaattgaaaaactagtgttttttgaacatttgctcgcacaaaaagagattacaaatttggttgaagtggcgggatgttcaaggcgaactttgcagagagtgaagaagaatttactgcttaaattgaaaaacgctttaaaaaattaaataaaaaacgtagcaaattaaataacgaaaaccgtatttttgctgaagttaggttgatttttagggggggtgccagtatacttatcaacgtgaaggtggttagagcgctatttagagcatgttctgattcaataaatgtgtttttttatgctaattgtgaattttctatgaattttcatatattttttgtataatgatttttagtgttactaaaaagtaaaaaataaaagaggaataaaatggatcataagaacagtgataatgaattaagacatcgctcacatcatcaccgtcatcatcgacgtaaaaagttttggcgtatcttttggattgtattaggtgtcttcctagcagtagacatcattgcggttattatcgcttggcacaatatccatgttgccactaacaacatgtataatccgatgagtaatgagattagtgatcggaaggttagcgacacactgaaagataagaagccaatgagcctgcttttattgggaacagatacaggtgaatttggacgttcttacaaggggagaacagataccattatgatgatggtcatcaatcctaagaccaataagacaacagttgtcagcttacctcgagatatgaaagttaacttaccggattatccagactattcaccagctaagattaatgcagcctatacttatggtggtgtagatgaaactgttaaaacgatcaagaagtacttcaatgttccaactgatgcttacgtcatggtaaacatgggagggcttgagaaggcaattgatcaagttggaggagtgacagttaagtcgccattaacatttgattatgaaggctatcacttcactaagggcgtaacttatcacatgaatgggaagaaggctttggcattcagtagaatgcggtatgatgacccacgaggagattatgggcgtcaagagagacaaagacttgtaattatggcattattaaagagttccatttcttacaagacagtcgttaaccaaacattcttgaattcaatctctaagcagacaatgactaacttaacgtttgataatatggttgcgttagctcagaactatcgtcatgcaactgataatgtcaccactgatcatgctcaaggacaaggcgattgggagaatggcgttgcctatgagtcagttagtcaagcagaatgtcaaagaattagtaataagttacgtgctgccttagggcttaagccggaaaccttaaagacaggagaataggaaaaagtggaaaacagtacaaaaactgaaaatacaatcgatttacgtagattatggatgcttcttcgagcacatatttgggccattattgcttgggccgttggtttaggagcagtgggatttgtcttagctgcttttgtagttgagccaaagtatacttcaactactcaaattttagttaatcaaaaaagaaatacgactgatgctggccaagcattcaatgctcaacaagctgatgtccagttaattaatacttataaggatattgttactagtccagttattttaaaagatgcttctaagtggctaaaaaatcctactgaagtagtaaaagcagctaaaccagctaaatatcgcactttagcagatgggactaaaaagttagtaagcccagctgaaccagcagttgttagaagagcgggacgtagttataatgtgagcgctaaggaaatgcaaaaagcagtttccgtaactacgcaacaacaatctcaagttttcacgattagtgctaagagtaatgatccagaaaaagctcaagcaatcgcaaatgcagttgctcaaacatttaggagcaaaatcaagagcattatgaatgttaataatgtgacaattgtatcacctgcttctcgtggtgctaaaactttccctaagacttcactatttacatttgccggtattattcttggattaattatcagtgtagctttaattgtcttacgtgattcatttaatactacagttagagatgatgattacttgactaaagaattgggtttaactaacttaggtcatgtatctcacttccacttatctaataagtttagtattaataataatgaagataattctggtaaaaagaagcgagtataggagagtataaatgggattgtttaatagacgtaaaaaacgcggtactgatgaaaccatgcaatatggtgctaagttaattactgtagcaaaaccacaaaatccagtaagtgaacagtttagaacagttaagactaatattgattttacaagtgttgatcatcaaataaaagctttagcatttacatcagctaacattagtgaaggaaagtcaacggtaacagttaatgtggctgttacaatggctcaagctggaaaaaaagtattattgattgatgctgatttgcatagaccaacattgcaccaaacatttgatataccaaatcgagtgggattaacaacaattttgacctcacactctaatgaagtagatatggctaacattgttaaggaaaatattattcctaacctttcagtaatgccggctggtccaattccacctaatccagctcaattattaggttcgaacagaatgcgtgcgtttctaaatatggttaaagagcactatgatctagtaattttagatttagctccggttttagaggtttcagatacccaaattttagctggtgaaatggatggagtagttttagttgtacgtcaaggagttactcaaaaagctggtgttgaacgagcaattgaaatgcttaacttaactaaaacacatcttttaggttatgtaatgaatgatgtgagaactggtccagatggctatggctatggttatggctacggttatggttatagtaaagaaaaagatacagaagcgaagtgataaataatggtattagttgatattcactcacatatattgccaggaattgatgatggttctcctgatttagaatcatcattagggttagcggaggctgcagttgcggatggaattacgcatgcactaatgactccgcatactttaaacggaaaatatctgaatcataaaaaggatattattaaggcaacgactacgtttcaatctgaattaaagaaacataatattccgttaacagtctttccgagtcaagaagttcgtctaaatggtaatttacctcaagctttagacgatgatgatatcttattttgtgatgatgatggtagatatatgttactggaatttccaagtgaagatgtaccaacttatgctaaagatatgacttttaaattattgggtcggggaataactccaataattgttcatccggaaagaaattctggtatcttggctcatccagaaagattgcaagaatttatcgaacaaggctgtttaacgcaaataactgctagttcgtatgtgggagtatttggtaaagagatcgaaaaattagctgatcgatttgtagaagctggtcaagtagctacttttgcttcagatgcccatacattgtcaaaacgagaaagtcgaatgcatgacgcttatgaaaagttagaaaagacgcaaggattggatgttgctaatagctttaagcagaatgcaagaaacattatcaattctgataatgttaatttaaatcggaaacctttaaagaaaaagaagcgtttctggatattttaattttattattgggggatagagttttaaatgatggcacaagacgttaaaaaagtagaactagatccgtcaaaagttaatggacgtgtaggataccgtgctgtaaaacgtgggtttgatattttagctagtggattggctctgatattattgtctccattatttttggttttaattgtcttaattaaaaaggaagatggtggaccagctttttattcgcaagagcgaattggtaaaaatgagaaaccatttaaaatgtggaagtttcgttcaatgattgttaatgccgataaaatggtagaacagttagaagaacaaaacgaaattgacggggctatgttcaagattaagaatgaccctcgcgtaactaaagtgggccatgtaattagaaaatatagtcttgatgaactaccacagttatggaatgtgttaaaaggtgatatgtccttagtgggacctcgtccacctctaccaatgggagtagaagattatacaccatacgacaggttacgattgactgttacaccaggttgtactggtctttggcaagtaacgaagcgtaatgatgcagactttgatgaaatggttgaattagaccttgaatacatcaataatagtagtttatggtttgattttaaaattttgttaaagactgtcggtgttgttattcatccaaatagtgcttattaatggagttagaatgaagataaaaattttaattgctgctcataaaaaatttccaatgccagctgttcctggatacttaccagtattagtgggcgccaagaaaaattataaaccagatattccttatcaaagagatgatgaaggagataatatatctgaaaaaaatcctaattataacgagttaacagctatttattgggcttggaaaaatttaaaagatgtcgatgctgtaggcttagttcactatcgacgtctttttttcgataaaaaaccatataatttagagaacgttataaatattgaagaagtagaacaactcttacaaaaatatgatgtacttttacctaaaaagagaaattactatattgaaacaaactattctcattatattcatgcacatcataaagaacctttagataaaacacgcgaaataattgaaaagtcatatccagcatatttaacagcttttgataaagtgatgaaaagccgaaaagcacacatgtttaatatgtttattatgaaagctgatgcatttgattcatactgcaattttatgtttggggttctagagaagcttgaaaatgaaattgatatttcagattattctgttcaagaagcgagggtatttggatatatttcagagcttttaatggatgtttggttatataccactaatgaaagctataaagaaattccatggggacaaattggccctaaacaattagtgaaaaaggctattagttttgtcaatagaaaatttggaattggcaaaaaacaaactcatttttagcatgatttatacagtaggtggaaagtttgaaaaagattcttcaaattggaatgacgtctaactatggtggaattgaatcttttattatgaatgtatatagaaatattgatcgtaataaatttcaatttgattttgtaaacatggaaactggtggaaaagatctggcttattcggacgaaataaaaagtctaggtggaaagatttataacataccaggaagacgagaaaatttaaaagcaaatagaaatcaactaaagaagataatcgaagaaaataattatgactttgttcataataacgttttaacttggagttattccgatggtattacattgccattaaagtattctaactctaaagtaattgtgcattctcataattcatatatgaatccaggaatgtatgcacgcagagttttaaacttttttaatagaagacttaattatagaaatgatataatccgcctttcttgtagtgaaggtgctactagatggctatttagaaatcgttctgcagtagtaattcctaatgggattgagacgaaagactatagttttaatcctataattagagatgaatatagaagaaagttcaatgtagagaataaaaacgtttttttgcatgtaggaagattatctcatcaaaagaatcatgactttttatttagatggttcaaagaaattctaaaaaaagattcgaattcaattttatttttggtgggagatggtgaattaagagaaaagctacagcaaaaagcaaaagaattagatatttcatcacatgttaaattcttaggaataagaaatgacgttaaaaacttaatgtttatgagtgatgcatttctatttccatcgcattatgaggggttgggaattgttctcattgaagctcaagcaacgggtttacaatgtatcgcaagtaataatatcgagccagaggcaaaagtaactagtcaaattaaaaccattgatattactgcttcacctgagaaatatgttgatttagcgttaaaaagtgttgaagaatcacgtgaatctaaccgtataaagtcatataaggaagttcaaaaagctggctatgacattagtaatactgtagaaatattagaggggatttattcaaagtgaccgcgaagaagctattaattgttggggactttattagtggaagtggtttgactcagtttatattcaatatgtttcctcattttgatgttaataaatataatattcaatgtgtaggatatggaattgattcaaaacaagaaacaaataaaacatgtgatgacttagggtggcgattagaaagggtagtacctataacaaaacggccattggcacatgtgaaatggtggaaagactttctaaaaaataatgattttgacattatatattttaactattcgtcttcttggaattattttcctgtaaaatatgcaaaacgctatacaaatgcacaaatagtttgtcattcgcataatgcatattatagtcatgtttttaaaaataaaattttaatgtatttcctgaatgtaatgaataatagaggaaaaaaaattcttaataatatggccgatgtgaaattagctactcctaaagattctgcattatggatgtttaatacactaaaagacgtaactgttatagataatggaattgaattagataattttaaatttgatgcgaaagcacgtaaagaacttagagctgaattaaatatatctttaaatgaaagattaattggatttgccggtgttttacaagaaagaaagaatcctatttttgctttacaagttttttcagaatatcttaagagcaatcctaatagtacattcttaatgatcggtaatggcccgatgaagaatgaaattgtgagaatagccgatgaattaggaattaagaaaaaagttaaatttataacttacactaataaattaaataaatggtattcggccatggacatacttttatttccaagtttatatgaaggatttggtcttgttccattagaggcacaggtaagttctttgcctatccttgcttctagtaatgtagcaccacaagtgtttgtaacacaaaatattaaacgaattactgggtatgacaaagataattgggttaagaagttaaatactataaagtttaaaacaaatgaggaaagatcatcacttgattcgtctttaaataaatttgatgtgaagaaacaagcaaatcaaatatctagtttgctagaaagtgaaaagtgataattaatgaaagttatgcattttaccgctggttttgttaacggtggagtagagcaagttttattaaattatactggtaagttaaataaagattatgatgtaaaggaatcaatagtttatctacatactgcagattcagcaaaaaagaaaatgtcggaacaattggggaataaaatgtatcaaattccggctcgaagagaaagtctgtggggaaatataaaatcaacttaccaactgataaaaaaagaaaaacctgacgttgtacatagtcatatgagcctaatgaatttctttccactaactattgcaaaaattttgggtgttccagttcgtgtgtcccattctcatttagccctaaatgatagtgattctgttaaagataggatttataagaaattaactagttggtcagccaacgaattagtagcgtgtggtgaagaggctggaaaatatctctacggaaatcaaaaatttaatatcttgtttaatgcaattgatcagagtaaatatcaatttaatcaatctgcaagagaagaaataagaaaaaagtatcatattccagaaaaatcatttttaattggaaatattggacgagtggttgaacaaaaaaatcaaaaatttcttgttgaaatatttgataaattttatggtgagtatcccgatagttacttaatgattattggaaagggcgagaagactcagcctgatgaacaagaattagaaaagtacattaaatcaaagaaaagcgcagatcatatcattagagtacgtggtgtaaaaagtactgaaaagttttattctgcatttgatgtatttgctatgccttctctttatgaaggcttgccagtagtagcaatagaagctcaagcatctggtataccaacaatactatctaaaaacatagatccttcagttatatattctgataaagtaaaactactctcaatagatgagggagtaaatccgtggattaatgaatttcaatcttggaaaaaacaggattttgatcgtagttttagaggaaacgataattataatattaatgttcaaaataaaaaactatatgactggtattattcatggataaacaaatataagtaaagatgagtaggagtaatatgaaaaataaaaaaagcgttgattgtgtagttgtaaccttcaatagattagatttattaaaggaatgtgttgaagccattgagagtcaaacctatccaatagaacatttttttattatagataattgttctactgataatacttgggaatatttacaatctattaaaagtgaaaaaatagttcctatacatctagaaaaaaatctaggaggagctggtggttttaacgccggtttaaaaacttttattaataaaagtaacgcagactatgtttggattatggatgatgataccatcccaacctcaactgctttagaaaaattaattgataaatcaaatatttcttctcatcttggatttttatgtagtaatgtacgttggcaagacaatagtgtagctgtcatgaatattccaagtccagataaagaatggaataaatatagtgatcaaggtgtaacgaaagttaagtcagcatcttttgtatccattatgtttcctagaaatgtagtaaaaaaggtaggatacccaattactgatttctttatttggggcgatgatgttgaatatactcttagaattacgcatgattatcatttagatggatttatggttaatgactctttagtagagcataaaataaagcaaaatattgctacggatttggttaaagaagagagcttgggtcgtgtaaaacgttactatttggcacagcgtaatacaattttttatcttaagaaacatagtacaaaaaaagaagtatttaaagcaaccatacgtcaaggagtaaaggtaccaattaaagctttaatcaagtctaaagaccatagattttatagagcttgggtatcagtaaaaggtacagcagcgggattattttttaatccaaaaatagaaaaggtagaaaaacgagataactttaaataaataggtttagtttaaagaggcttgtgacttaataaattctaatagaggaaaatagtttataacctatgaaaaaaaatgtatatagtgggatctgcgcctatttacttgcgatgattataataataaattgtcgttctgtttggcttagtaatccaaactggttaaatttaaataatataacttatattttatttatacttggatcaattaccttaattggaataaatataaatagcattaatgatttaaataaaacaattttaagtagtgtatttatttttctatacttttttgtttattttatttttagaccaataggattaactcaaaatataaagttattaattatagtaatgatattaatatgggtaatgcaggttaaaggaaaaaatcttccgttaattcttgaagcatatgctaatcttatggtttttattgctgtgttatcggtaattatgtggattttatgttctttgattaaagttattcctccgactggcactatcccgtttaattggacagctgttaatggagtgcatagttttattccaacatatggtcacatatattttgaaacgcaagatataaatcttccttttattggtaatataataagaaatacagcagtatttacagaagctccaatggcatcattgaatttttgtattgcttttctcttaaagctaaatgagaatagctataagaaagatagcggaatatctaaatcacaaatttggttaattatagctattttatctacattttcaacaactggttatattttattaattttaattttctttataaaatggcttgaagcagataaaaaatatttcatttataaacttatatttgtaattcccgtattaattgttgcaatattgggaattaatttacttattggacaaagaaccgtttatggtactatgtcaacaaatttaagatttgatgattatcgtgtaggaataattacctttttccaaaatccttttttaggtgccggtctaggaaatagtgatgcgctagtacaaaatatgggaaattggcgtatatatatgactggatttagcaactctatcactgaagttttagcccaaggaggtatatacgtcagtttgatatatgcatatagctttataaaaggaatttactatagttttaaatataaagcgttgaatggatttatattagtatttggaactctatatctgttttgtacaacgatattcagctatcagtatatattaatagcattattaattttgtttatagactttaagatatattttaatcatagataaataatatatagtaaggagaaaagaatgaagaaaaattatttagttgtaggatcaggcttatttggtgcagtatttgctcatgaagcagcaaaacgtggtaataaagtcactgtaattgaacaacgggatcacttggcaggaaacatttatactaaagaagttgatgggattcaagttcatcaatatggagcacatatttttcatacctcaaataaagaagtttgggattatgtacaacaatttgctgaatttaatcgatacacaaatgcgcccgtagctaattattatggtaaaatgtacaatttgccatttaatatgaatacttttagtgaaatgtggggagtaaggactccgcaagaagctcttgaaaaaattaatgaacaacgtcaagaaatggcaggaaaagagccacaaaatcttgaagaacaagctatctcgttgattggacgtgatatctatgaaaagttaattaaaggctacactgaaaaacaatggggcagaaaagcaactgaattaccagcattcattattaaacgcttaccagttcgattaacttatgataataactacttcaacgatgattatcaaggaattcctaaaggtggatacactcaaattgttgaaaaaatgcttgataatgaagatattgaagttaagttaaatactgatttctttgataataaagatgaatatttaaaaaactttgataagattgtttacacgggaatgattgataagttttttgattataagttaggcgagctagaataccgttcacttcattttgaaactgaagaaaaagatgttgataattaccaaggtaatgcagtaattaattatactgatgcagaaactccatatactcgtgtaattgaacataaacattttgaatttggtaaaggcgataaaaataaaacaattatcacacgtgaatatccagctgattggaaacgtggagatgaaccatattatccagttaacaatgaaagaaataacgaattatacaagcaatacagagaattagctgaaaaagaaaacgataaagttatttttggtggtcgcttaggtcaatacaagtattacaatatggatcaagtaatttcagctgctttagagtctgtaaaaggtgaatttgaaaaataaaatgggaaaacatgcgtatctaataattgctaatcgaaatcctaatcagttagctactttaatagcaaccttagatgattctagaaatgatatttttattttattagataagaaatctacaagtatctttccagcagtttataaagcaacctatgctactgtaacgatggttgatccaataaatatattttggggagattattctcaaattgaagcagagctagcactttttaaagctgcaaacaatggccattatgattattatcatttactttccggtcttgatttaccattagctaatcaagatcaaatacatgatttttttgataaaaatctaaataaagagtttattacatacagtggagctttaaatccaaaagagttatcagtgagacttcataattatcattttcctaatacttttagaaccgataacaaatttaaaggtctttatcatagaatagaaacaaaactatattctaaaatgccacaacgaagaattaatattgataaaattagttttggctcaaattgggtatcactggataatgagcttgtctcagacttagtagataatgaagatttaatttatcacttattccataatggatttttagtggatgaattatttattccaatatttattaatctatttccaaaatataaaaaacgagtatatgactcaactaaagttagtgataaaccagatgagtttcaaggaaatttacgttatataaactggtgggatggtagtccctatacttggcgattgaaagactatggtatgcttcaacaagctaagaaaaaagggcatcttttttctcgcaaatttgatgaaaatattgatagcgatattataaaaaaggtagtaaacaataatttaagcagttaatatgaaggttataaaaaattatctatataatgtaggatatcaagttcttgcaattattgttccactaataacttctgcttatgtaagtagagtcttacgaccagaaggcgtaggggcaaattcatttacaaattccattattcagtactttattttaatcgcaaatatgggaattggtttttatggaaatcgacaaatagcttatgtacgtgaaaatagagctcaaatgtcacaaaccttttgggaaattcaaattgtaaaaacaataatgactctatatgcattcgtagcatttgaagtatttatgattttttatactcgtcaacctgagtatatgtgggcacaatctattaacttaattgcggtggccttagatatttcatggttttatgaaggtatagaagattttaaggttactgtgttaaaaaactcctttgtaaaaataatttcgatgattgctatttttatttttattaaggggcctgatgatgtaactctctatatcattgtcttggcgctatctactttgctaggtaacttgacattgtggcctaatattcgacgtgacttaagtagaacagattggaaaatattaaacccatggcaacattttttaccaatgttggaactatttattccccaaattgcaactcaagtctatgttcaactcaataaaacaatgctcggagttatggtagatgaaacagcatcgggatattatcagtattccgataatttagtaaaattaattttggcacttgtaactgccacgggaactgtaatgttgcctcatgtggctaatgcagtttctcatgggaatatggaaaaagtgaataagatgctctataagtctttcaattttgtttctgctatttcataccctatgatgtttggattagctgctatttccttgacattagctccaaaatattatggtccaggatatggtccagttggaccagcaatgatgattgaatctattgtgattttaatcattgcatggagtaatgtaattggagttcaatatttgcttcctatccatagacaaaagcaatttacatggtctgtcaccttaggagcgattgtaaatctaatcttaaatgtacctcttattaaaatgtgggggctaaatggggctatgtggtcaacagtcatatcagaaatagctgtaacattctatcaaatgtgggctgttagagatcttctaaactttaaagagctatttttagactcttggaagtattgtgtagcagggatattaatgtttattccagtcttttggatgaatttacatttgcctcaatcatggttaatgttaggtattgaagtgcttattggaattttgatttatggagtagctatttggatattgagagcttcaatacttgacgaagctagaaggctaataaaggaaaagatacataaataagatgaaaaaaagacaatcaaattttgaactattacgtataatatgcatgtttttaatagttgctggtcatgttacatggcaaactaagttttcttatgatgaattaaatttggttcatcgagtatctattcaaagtttatggatgggtggagaactaggtgtatggggttttaccctaatttcagcttattttttaagtggatcacattttaaaataaaatccttgaaaaaaatctggggaattaccttattttattcaatatctatttacttattattagtgattttccatgttattccaatcactcctaaagatgcacttaaatcttttctaccagttttaacaggaaattattggtatgtttctgcttatattggtatgtatattttagtgccatatatgaatattgtaattgaacatttggataaaaaagaatatcaaaagcttcttttacttctatttattatgttttctttacttccttatttaaagaatattacagtagtaactaataataattctgtaattaatttagtttatatttattttgtaggaggatatctaagaaaatattcttctgattttacaaaagaaaatcaaaaatattatattttaatatttttaggatcactaattttaatgttgagctctatagttgtactagatttgattagacctaagtcatggtttgcatttttgactacatcaagtcctttagaaactatagctggtgtatcgctctttttgattgttaaaaacacctctatttcttataaccaaataataaataaaatcgctgcatctacgtttgctgtatatttaattcactgtcaagctatttttctaccaattttatgggataagattgttcatgcacagcaatggcaaacgattccatatacggcaggatatgaattgctagttgcatgtgttatttattgtacagcaacgctaattgattttactagactatatattttacacttatggtcaaaaataaaagttagatttggttaaaaataaagagatacgaacaatatgaaaagaattagagactcaaagtttgaattattacgtattgtttccatggtatttattgttatttcccattattcgttatggggaggaaggaaacctatagatatgaatatttaatttatcaacctttaggataaattggtgtttgtgtatttatttcaggttactttttatcgtcacgtgttttgagtgcaaaggatggctggcacagagcaaaaaattagggataaaaactttaatttattcatggctaatatttgtagttgttattagcataacaggattaaaaaatttatctattactaaaatcttaacagcaatttttccagttgtttttggtgaatattggtttattactggatgctatttattccactttttaatcgaatgcttacgtccttaaataaaaataaacttaaatattacattgaaataattgcatttatttctacggtcttaccattgtttgttaaaagtcttcgtccatttggagatatgaattcggcatcagttttaataacagtttatttaatagccggctacatgaaaaaatatgatataaaattaagtaaatttatatcatggggcatatttatataggtggacttatccttgaattaatctcaattatggtattaagaaatcatggtgataaaatgattcattttccttatggtatcatttcaatggtttctgcttttggattatttaatataggcatttcgatgaagagcttttataataagtttattaactatattgcatcatcggttttggcagcatatctcattacagaagatctatttataagaatatggttatggaatgacttccttcatgttcctaagttgcagaactataattatcttttctttcttttgtatggaatagttatttccacattgttagttagtgtatgtcggttaatagataaaatatatgaacaaattgaaaaaatgattgtaccaaattaagtatatggaaaactagttcctaaactactaaaaaatagatgagcttcgttatgaagagtatctctttttcaatacactttagtttttgacgcttattatctttatctgcatgaatttagaaaaaatgcccatcagtacttatgagtatactgatgggtattttattgcagaaaatagaaaacttgtaagcgtcaaaaactgaaggatatttaaaaagcggtctagttttgatacggggtgtatctgttaggccgctttcatttgcttctcttttgttttacatgattcatgaacttcttttgtccatggtaataagccgacattctttctttatctgtcagaatctcttcatttggtaatttatccaatagatattcaatatatttttctggatcaaggttatttctttgaatggtttcaattaaactcaaaatgataggtgaagtttgtgcaccttcaaagatttgtgagaataaccaattctttcgttcaagcagtaatgtcttgattgctcgttctgcctgattattagagaaaaccagcttgccatcaagcaagacattcttgaaggtcttttcatgatttagtgcataagcaattgctttaccaagtttgaatcctgatagaatcatcggttggttatttcggcactagtcgaagaattcttcaaatagcggctttagttctttttgacgtctttgatagcgttcttcattaggtaacatctcccatgaactctctaatgtaaacatcttatacaatagtgaataccttgtttagaccgagtagtaggcgctatccaactaatgttgcactagttaattgcttatagaattgtcacaaacaatatatacttggtctagatcataaagattactcatgataagaacttctctaagattttagctattattcagaatctaaagaactataaaatttaattctaaatctgtatttttaagacttagaagccttattgtttttggaaacttagttttatctgttaaaggtacaagatcgtatttatggtttagaaaatctgtcttctcaaaattgatatgacgagtatgtgatgaatacgaagcggacggtagatattttagtttttgacccttatgttataagtacgacttttacaatgttttatttaaaataaatactcacgaaagcagagatgctgcattcgtgagtaaatcgagaagatggaaagcttaatattgtaattttttcttctcgtgtatagtattgtatcatgtatggattctaaaattaagttttagaataaaaagaggctaggatgcaaattgtaattttaccgtatagccaatataatactttaaattaaacattctaagttaaatagggaatcgattattcatcaggacatcgattatttttcctttaggttgattttaattaagagatggctaaagacataagcaatacattcaattttacgataatctccttcaaggtgctcattagagtaagttgaggtaatctcgtttaggacaccagaataattacgtttaaaagttaatagagtttgatgcatttgtttatcaacggtttggtttgaataaagtagatgggtaacttccttttcctttttgtctttaatagcagtcataaagtcctgcataatccaatatgtattttcgagatctttattgcactctaagccgtctaagacaacatgttcctgagtgagatagtctttaaagtgccaatcgtagtagggagtagtcttattaagtttgtcatatttcatgagataaagcttccgaggagattttagaagcgtatattcgcgacttcttttattaaattgcttcctgatttgaactctaagtatattaaacgatctagtaagcatttgaacgatatgaaaacgatcaataactatctgagcatttggaaatagctaaaggataataacaattaagatccataggtactgttttaaccattggacgagccttagttaggggtgaacttgtgaaaatggcgtagaatatcaggtttgaaacgagttctaagaatttgaacaactttgtaagtatcactatctagacaaatagagtgaagctttttgcctacaccttggaattcatcaaaagctaaatgttcaggaagatatcaaatctattataaaatttggcagaacaggatgttaagactctttgaacagtattaactgataagttatgttctcttgcaatactcgtcatagaacggtgagcagaaaggactttaagtttttagagatatgacagtatttattaaccagattagattgagccatagatcttttaaacagtcattgcaaagaacatgttgttttcttaagctgatagtaacgggcttactagcatcaacagtaatgaaacgaacgttagaaacgtaatgaccgttatgcttaagattcgtagaactacaataaggacaagcagagtggataagctcagctaaatatattttgtaaattttaccgttaatattttcatttgaataatcagaaaaaataatattttgatattcaatatcaggaggaaatctaatataattatttaaagaggacatagtttgaatctccatacacttaattgaattggtcgaagaaggattttaagtaagagaagactatagcctctttttttatgtaaaaaaatcctgccgatagaatatcatagatattcatcaacaggaaaaattacggaactactgtatcaaagctagacggttttttcaacacatttcagtttttgacgcttataaactggatgctcaacctgaaattattaggaataaataaagtgaaacgatcagacttgatcgatccgctagagtactatttaacttgttagtgagttataaatgtaataccgtattcggtttgatacgtgttgtgtaataaaagggcaaactagaaaagtttcttcaactctatttatactgtctgctaaagtaggattatagcaaattttattttctccgcattttttctattgtatcattatgttactaagtatatgacttaaagttaaaattattaattattgctgtaatgttaaaaagcaaattgaaaggaataattaaatagtgaagaagttaaaaaatcttgttaatttagaaaatatttgtctaagctgtctgttagtttatataatagcttgttcaattcatccaaaatattttaaatatttaggtataagtatagaaatagtatcggttttattaatacttgttattagctatattgaaagaacaaaaaaagaaatagaaacctataagagtaaaatagaaaattatcgtattttaatagctagtctttttctttggcttgtaggttttttaattgtattaccccatcaatattctgttgatcttaaaaattggattggtattagttctattttaagcataggaactattttattcacttacaaccctaagataattgaaattattttagatggggattacgtaattgaagaaaaagatttagtaaaatattataaatgtgattcaaatttactgactgtttatgctattaatagatgcaacaaagatgtgaaactcttctataaaggaatatgtattgaggaagactggaaaaagttaaacagtggtgaaattactgaaaatcaagtttcgttttggaatgacactaaagaaatagataaggtaccgcaaaagaaagattacaaaacaattggtaaaaatgaggaaagtgagttttatagaatagatgtaaaaagattaagaacaacgtacttaaatgatttagtaagacaaaaaaattgggtaattgtatttaaagacattgggggaaactattggactaaaaagtttcaaatttaaattaaaaaatctagtaagcatttgcgccagcaattaatatattaggcttaaagtgactgttgagtatttttataactcaatgtagatcgttaccacctaagtaaatagagtgcattttttgtcaactcaattaaaattatcaaaagctgccggaatatgatcacagttatagtagaacttcaaaaagcagatactaagatatttaagatagtataagaaaaaatcatgttaaccataaaatagtcgtttttagtaggagaatgaatagcaattaaataaagatctctttactaacagcaatagagtgcctcgttgttatcatgattaaagcattctttgttttctaaatttcataataatatgttttttagtatgagaagaaatgaagtacaaactctcatgagaaatatagtacgagtgtagttagaactaatagcctgtagaaaggtaagcataggatattagtttagcttcctctctgaatctaaaactttggtacatgtactttatatacagactcattataatacaagataataaggattcagattttacttaatttgtcgaaagaagtatttatttaatttgttcttttatacttcgttatcttgcaataaatacatcttggaagattgtggtgatggacagaaaaatggaaaaatattttgatcaatataaaattttagataagtttttaattgttacaattaaaaactggataataaaaaacaaaagcttgatagtgagtacaaatttttggaatagaacatttgattttgttgtttctatatatttaggagtaattgccttatattttctaattattatgattgtaaaaatttatcaacgtacaagtcttgaaaataggcaattactagatgcatatacttatccaatattaggggtattaatcttttttagtatccttatagccacagtaaattatcgatggattttacctaaaggtagaaaatggatagatttcaaatttacgcttcctaggaaaaaacgatcagttcaattttttgttgtaattggactaatattaccttttattatgtgtgtggtggggtggccttatttattaagtgaaatatataaatacaattcaaacttttattgggaaatttcagaatatgatgtaccttcttttttctttccgctttttaccggaagtatcgcaatagtgacatattttaattcaaaacatcctaatttatctattattgtaaatagtcctacctcaatgcttcattctaattatgtaagtataagtgtaaaaaaaaagaatcgttttagagatatggtgtaataatactggaggaagagctggaacatttaaatttgttggcattgtatctagtgatactcttagaaagattaatagagaacatagagtcaataataaacctaacttattaggagattatcttcgtagagataacagttggcaaaaattagattctggagaaaaaggatctagtaatttggcaagtatagatgaaaataatttagatataataaatcaatttatttatgtactatatgtagattcagaacaagttccgtatttttatggaatatatctagatggtgattcatgatacaatttaattataaaaataaagttattaaaaataataactattgcaattcttaatagctgaaaaatttgaaaggtgataaaattttataaaataggttgtaaaaaaaggatttttttgtgtatgaactattttatagtctttaatgtaatatttataatgttaagctattcatgaatgatacaatgtataattaatggaacttcgatgtataattttcggataaatctatacatttaaaggtaaagaaggtgggagtaatggtaactgcaacatttaaagtcaataacaaaattttaaaatgggttttacagattgctgatgataaactaggtgttgattggattgataaaattaaagtgtggatgaaaggagaaaaaactcccactattcatcagttacaagttctcagtaaaaagtctcaaattccttttggaaacttctttttgtcagatcctcctatggaagagattccattacttaagtttcgaactattaataatgacgaagtaacaaaagttagtagtgaattgttaaaaatgattgattctatggagatgaggtcagattggcttgaagattatagaataagagagggatattctccaattttgtttgtaggaatgggaaagcataatagtcaacaatcttcggaagaaatcgccaaacaaattttgaaattttttaatctaaaagaagattggaatattcaacttaaatctaatcaaaatgcattcaattatcttagaactataattactagtcatgggatagtagtagagacgagcagttttgttggaaataatacaagagatggcttaaatattaatgaatttagagcatttgtattaattaaaagatatgctcctttaatttttatcaatacaaaagatagccaaaatgcgagattattttctttagttcatgaattagtacatctgtggtatggcaaaactgaattatttaattataattttcaaactgacccaaaatatctaaataaaaaatttgaacagcgggtaaataaaatagctgaatccattatatttaataaaaaatattttattagatactgggatagtattagaaactcagattttgaaaaaatttataaaatagctaaaaaattcaaagcaagtcctatggcaacggcaataacagctaaaaattataaattgatttctcaagaattagttaatgaaattaacaaagaaacttcacaatttatagttaagtcatctcataccggaggtcctaatttctatgacacgttggcgtataaattagatcataattttgcgtctgctgtgattaatagtacggatcagggagatacaacctatttagatgcatttaatttgttaaatgtgaagaatatgcacgcttacaatgaattaaaggctagagtggaggagaaaaataaatgaccaagtatctcttagatagtaattgttttattgagccaatgaagcgatattatggttttaaaatttttccctctttttgggagtggtttggaaaggaaataaataaaaccaatagtttattaattgtaccgaaatgtgtaagtaatgaaattaatgtagatccgaatttagctcaatggtcacagaaaaatttagtttcagtaatttatgatgaaaatcaagaccctttaatttgggccgaatatgggaaggttattaaatacattcaagattgcggtgcatataaatcaagtagtataaatgaatggaaaaaaataggtaaagctgatcctctgttaatagcaattgctattaaatataattatcaaatcgtaacatttgaaaagggaagtggtcaatttgcctatgataaaaataatagatggaattggaaaggaaatgtagggccgatgggccatgagcctaagattccagatattgcccgtcattttggtatcacttgtctctccctttttgaactagaaaaaaagttgaatttaactatttaatcttaattttcattcatataaatggctgtttgtcaaatcctgttgatgaatagtttataaagagagctaagcaattagaaaataattgtttggctctttttcttttataatattttcttcgagtctaattctaattaaaagaaaaattataatagctataaaaatttgttaactgaattgttgagtttacgggtcctaacagcagtaaagcaatcggtagaggtggaataattgttcgacttaatatttagaagagtataggaaaatattaggtaatgcttaattcttacgagtcttgttattatatacttatttaataaataattagatttttatctataatattagatagcacttcaattatgtacttagaaaaactatttaatatattagcgaaattttagatatggtttagatgatatttaaggagaaacatgggaaaagaaaaaagtatttttagagagttatttactgaattacaacaaacaaatattatgtacatatctttaatttccatatgtttgctgataataattgattacttgaatccaacaggaagagtaatggcagagttatggggaagtaccgtagtcattgggatattgatatcattttggttcgtaataaataataaaattctacttttatttaaagtaaatagcataaatgcattagatgatattaatctgtatattgttataagcgatctaggatatggattatatctcttaattaccaaacagtatttctcatggaagtttgtagtagtacttcttatcgctttgctttctttgtcgatagggatttatagaataatatgtttgcaacaagcgattttaaagagactaaaaaatgatgaagaatgccatttggtagaattaaaggacttatataaaaataatttaaatgtaagtttgccaatatttattaaagatagagcagtaaaagatgatttgttaggtcgagacagtataattacactcctatataaatcaatctgtcagaacttttcaaaacaagattctttcgttatcggattatcaggtccttggggttcaggaaaaactactattacaaatattgttcgtaaacagctagaagcgcaaaattcagatattaagattattaagggactcaatccatggatttctggctcagaggccgttttattaaattcattctatgatgcattgttaaatgctttagggattaattacagttcgcgaaaaatcagaaaacagttaaaagaagtttcaagatatgtgattgaaattccaactgtaggaaaatcattgagtaaggtaatggagaatgatattaatcaagaaaacatagagaaatggcaagctaatctaaaaaatttgattttaagtagtaataaaaagtatgtcctgtttattgatgacttggatagagcaacaagcacacaaattagatttcttctaaaaatgttaggatctttgtttgatttacctaatttgatatttatactgctttatgataggagtagattagaaaaaatattacaagacgataataaattaaatacttcttttgcagaaaaaataattaatctagaattacaggtacctaaaatatcagaaaatagtgtgcaaaaaatttatagaagctgtttgattaatttagctagaatatataatgtttcagataaagaagttaataatttagattccgcttttcaattgatcataaagagtattgataatcctagagaatttatacgttttttgaattcaatatgttatatagccttttctcctgatattaatttaaatagaaatgatttattattgattgagtatatatcgtttaaacaacctgatttatttcaattaattaaagaaaatccgaagttatttgtttcggagaatagtgagttagatatttctgatgtatttaatttaggaaaatttaaaattgaaatatatggtttttattctaaagttttaaaaaataaatattcaagatggttagcaattttagaagtattatttccttatatcgaacaatgccaaatgggaaaggaccatttgcagataaataataattctaatgaaggtagaaagaataatagaatctacgatggacataattttgatttatatttttcattaagtgaggactatgtattaggaaaaaataaaaaaataaaggatattgtagataaactaaaggaaaaatttgataataagcaagttgaaaaacttaaaaaagaaatatttgagggtagtaaaacaaatgtatctgaaaatattcatttgttttccatgtataaaaatgaatttaatagtgtgacaggggtagctctaagtagagtaatcttagacaatatggaaaaaattcctgagaatagtaaagcatttgtattatcagcacgtagtatagcagcttcgacatgtgttggtttattaggagatgcgccaaaagaaaaaatttctgaacttttagaaaaatatagtactaagtatgaattaattgatgtatttgatgatttatacacttttagtaaaagctttggaaaaatatatgaaatttcaggctcaatatggagaagaatgtgtgtagatattattaaaactcctattaatttatataatgatcagtattaccaaccaaaattaatcttgaaattatatagaggaatagaaggagataaaaataaaataatttcggactatcttagagctatagccactaaaaataatatatataagatattttatgattttatgaatgtttctcatagcaatgaaggaattggctatacatttaaagaagaaaatcatcatatattggaagaagtacaattagaaaatattttgcccgatccaataaatataagtcaaaaggtaatttttgatatctattcaaaagggtcgagtgacgctttcgactacaagtataaagatacagaaataaatattgagcaattataaaaacacgctatatgatataaaaagaaaataaaatttatgccaacttactacacaagtggcgaatttgcgaaaaaagcacacgtttcaattcgtacaattcgctattacgatcaaaaaaatttattaaaaccatcaacacacacggcaagtggtgcaagacgctacactgatgctgattttgcaaaattgcaacaaattcttctattaaagtatcttggattttctttaacagacattcgagaaatgactttaggatcaggagacaggcagcttttacttgattctctccagatccaaaaaagactagtagaagagcgtcttaaagaaatgcagaatgtagctactgccattgattcaactagtagcaccttgaaggcagggcaagaagtagactggaacaagatgttagacttgattcatttgacttcaatgaatcagtccttaagtactcaataccaaaatgcttctaatatttctgcgcgaatcaaacttcatcgagattattctcttaataaagagggatggttccattggttgtttagacaactagacttaaagccggggatgaagattctagaaataggtgcgggtaatggtactttatgggcacaaaatctagatagaattcctaaaggattaaccattgttttatctgatatttctgaaggtatcttatctgatgcgaagaatgagattggagacagagcagaatttcaatatgctgtttttgatgcacaaaaaataccttttgcggataatacgtttgatttagtaattgctaaccatatgcttttctactgtgacaatattcctaagaccttgaaggaaataaagagagtaatgaaaaagggcgcttcttttgcttgttctacttattctaagaggcatatgcatgaaattactgatttagttcaagaatttaatccagaaattgtcttgtcttcaactaacttgtatgatcgttttggcttagacaatggggcagaaattttatctcatgattttactgatgttaactgtcataagtatgaagatgcaattgaattgtctgaatctacgccagtaatttcttatattttgtcttgtcatggtaatcagaattcaattttactcgatcactataatgaatttaaaaattacgttgacgataaagtaagctatggtttccacattacaaaagatgcaggttactttatttgtaagaaatagcaacaaagatcaagcacattaagttaaatgcttgatctttttctatagaattaaaaattcttattttcttgaaggtgacgtaacgtaatgttatatgataagtaatgaataaagaaaggcagacctaattatgaaagttattgttactggtggtgccggttttatcggttcaaactttgttttttatatgttaaagaagcatcctgattacgaaattatctgtttagatagtttaacttatgcaggtaacttatctactttaaaggatgttatggataatcctaacttcaagttcgttaagttagacattcgtgaccgcgaaggtgtttacaagttattcgaagaagaaaagcctgatgtagtagttaactttgctgctgaaagtcacgttgatcgttctattgaaaatccagaaattttcttagaaactaatattattggtacttctgtcttaatggatgcttgccgtaaatacggtatcaagcgtttccaccaagtttcaactgacgaagtttacggtgatttaccattagatcgtccagatcttttcttccacgaagatactccacttcatacttcaagtccttactcatcaagtaaggctagcgcagacttgttagttggtgcatacggcagaactttcaacttgccagtaaccatctcacgttgttctaacaactatggtccatatcaattcccagaaaaattgattccattgatgattcaaagagcattaaacaatgaaaaattaccagtttacggtgatggtaagaatgttcgtgactggctctatgttgaagatcattgcaaggcaattgaccttatcttagaaaatggtaagcctggtgaaatttacaacattggtggtcacaacgaaatggctaacattgatattgttaaacttatctgtgattacttagacaagccatactcattaattgaacacgttactgaccgtaagggtcatgaccgtcgttacgctatcgatccagaaaagattcacaacgaattaggctggcttccagaaactatgttcaaagatgatatcaagaagactatccaatggtaccttgacaacaaagactggtgggaaaacatcatttctggcgattaccaaaattactacgatgaaatgtatggtaagaagcaagttttagataaggactaattcagcatgaagggaattattttagcaggcggttcaggtactcgtttatatccattgactttagtaactagtaagcaattattgccagtttacgacaaaccaatgatttattatccattatctactttaatgttagctggtattaaagatattttagttatttctaccccagctgacactccacgttttaaggaactattaggtgatggttcacaatttggtgttaacctttcttacaagattcaaccaagtccagatggtttggctcaagcatttacattaggtgaagatttcattaatggtgaagcatgtgccatggttttaggtgataacattttctacggtaatggttttactgacttacttaagaatgctgctgaagatgcccaaaaaggtaaggcaactgtctttggttactacgtaaatgatccagaacgttttggtgttattggttttgatgaaaatgataatgttgtatctatcgaagaaaaaccagaacaacctaagagtaactatgctgttactggtctttacttctacccagctggtgtaagtgaaaaggctgctcaagtcaagccaagtgcacgtggcgaagttgaaattactagtctaaacgatatgtacttacaagacgataacttaggtgtacaacttttgggtcgtggttatgcatggcttgatactggtacaatgcaaagtttagttgacgcttctaactacgttaaaatgattgaagaacgtcaaggcgtttctgtttcagctccagaagaaattgcttatattcacggctggattgacaaggagcagcttttagaagcagctaagcattatggcaagagcccatatggcaaacacttaaaatcagttgctgaaggtaaagttcgttactaaaatttttaattaagaaagaagctttttaaaatgggacaaattaaagttgaaaaaaatgttggtggaattgaaggtttagcagttatcactccaactgttcacggtgatgaccgtggttacttcatggaaacttttaaccaaagagatatgatggatgctggcttcagcattaacttcgttcaagataaccaatcaagctcaactaagggtgtacttcgtggtttacacttccaaaagaaatacccacaaattaagttggttcgtgctgttcgtggtagtgtatttgacgttgctgttgaccttcgtagcgactcaaagacttacggtaagtggtacggtgttgaattgactgctgaaaacaagaagcaattcttaattccacaaggttttgctcatggtttccttgttttaagtgatgaagcagaattctgctacaaggttaacgatttctggcatccaaacgatgaaggtggtatggcctggaacgatcctgaaattggtatcgaatggccacatcttaagggtgattacccgggcagtccagatgctagtggttacactcttgatgacggtactaagcttactttatctgaccgtgatcaagaatggaaaggcttaaaggatacttttaagttttaattagtgaggtaaattaatgaaagtttttgtaactggcgttaatggtcaacttggccatgacgtaatgaatgaacttgctaaacgtggctatgaaggtgtgggatcagacttagcacctgaatatgccggtgtagctgacggcaccgctgtgactaaggctccatacgtttccttagatattactgatgcagacgcagtagacaaggttatttctgaagtaaagccagatgttattgttcactgtgctgcttggactgcagttgacatggctgaagatgatgataaggtagctgctgttcgtaaagttaacgttgatggaactcaaaacatcgctaatgttgctaaaaagctagatgctccaatggtttacttatcaactgactacgtctttgatggtcaaggaactactccttgggaacctgactttaagggttacaagccattaaatgtttacggtgaaactaagcttggtggagaagaagctgttgctaataccttggacaagtacttcatcgttcgtattgcttgggtatttggtgtaaatggttctaactttattaagacaatgcttaaagttggttcaaaccatgaggaagttaaggttgttagcgaccaagtaggtacaccaacctatacttttgatttagctcgtttattggtagacatgattgaaactgataagtacggctactaccatgcaactaatgcggaattgccagcaagtgaaggcgaccatgacgaaaatggtactaagactggctatatttcttggtacgatttcactaaagaaatctatcgtcaagcaggctacaagactagggtaactcctgtaactacggaagaatacggcttatcaaaggctgttcgtccatttaactcacgccttgacaagagtaagttagaagaaaacggctttaagccacttccaacttggccagatgctatcagtcgctacttagatattttaaaggccgacggcttctttgatgagttagggaagtaaagctggatagaggaaaaagcaaactccttttttggggtgcttgctttttttgtgttgggagagaaaaactaagcaactcgatttggtccattttctttgatgatattacttttgcctaatgttgaacagtaaatgaatgacctgattttcatgttgatctttaataagaggtataaaatcttgcatagaccagaaaaaatggtaatcttcgatagggccgctcaagaagtttttttgaatgtgttaatcatccccttcagcaaggtaactagacatacgtcaattgtagttaagtacatgttggaatacgaaaaaggcttccaactagtggaaccttatcctacggagtagataggtggaaggtttgattagggaagacgcattttgatggtaattcaattaataagcaaatctttgcgtaatgaaattaaaattaaaatgcactttcaaaaaaatactaaaaaggcagaaaaattgaaagaaatagaatataatagatattaagaaaaaaagaaggagtgactatttgattatgacagatcttggttttactgacgatatggctcaacaatttgttaacggagccatgaaaggatttacagattatgtcagaagacgaaaggaggatgccgataagctcattgttagccgaggtgcaacatggatgaaaggaaattacattgatgatggagtagctaaagaattggccaacacaggtgttgaatatcagagaaagatggccgggtattcatgggaatatcttcaatttaatttttttgataatcaatctggaattaataatagcttaatatttaaaaattatagaactttaactagtggcatgcgtagtaaaagtaataaattgccagattatttagctaaagatgctctagttaatgtagatatcttaaggaaaaataaagaaaaaatccataaaaagggtgaatcaattcaacttgagcttttaccgcttgctcctgattattctgaacaggtagagactcaggtaaatggtatccaaagtcgtttctatgtagtaggatatcagttaggaaacgatggcaaccttgatactttgaatttattaatgcccaatccaagtacaaattcgttggtagaaattgaaaattggaataaatatatcgtagatgcacctatacaaccccaaatggaggatttaagtatctttcagaatgaaaaagatattcctgaaggtcaatatgatgatacttcaaatatgaggtatgagattgccgataataataaagaaaaagaaagttaatatagaggattagagaaaatatgttttatggagaaaaacttaaacagttgcgagaattgcaaggtttttctcgtaatgatctagcaaaaaaattaagtctaaccgaacaaactattggtcagtacgaaaataatcaaataactccgagattagacatcatggaaaagttactacaaatttttcatgtggatttaagtttttttaacactccgagttttgttgaaaaaaatgttatttcagaagaatcaattgcatatagaactaaagatagaaattcaaggaagaaaattaataacgagttaaaatacatagattatgctaaaacttttattgattactttgaaagctttgttacttctaatataggtggctttaatgaattaaaacagaaaattgaagagctaaaacctaaagattatactattgcttatattgctgatatcgttcgtgatttttatagattgaatgagaatagagaattgatgtcagaattagaacagagcggaataactgttttagaaaaagacttaggatcttcaatagatgcctatagtgggtttactaatgataatgaaccctatattgttttaggaaatctaaaaaagactgctgtaagaagaaattttgatttagcccatgagttaggacatttgttattacactcaaatatagttatgactgagataacagaaaaagaacatacagcaatagaaaaccaagcaaatgattttgcttcagcacttttactccccaaatatgaatttattaaggactttagtaatatcgctagaaaaaccaatcctgattattacattgcattgaagagaaagtacatggtatcaattgctgccctagaatatcgtgcatataaattaaaattgataacttatcaaggaaatcgatacttttggtctcaaatgaccaaaaagaaatatcgcaatttagaaccattagataataagatcccgccattaaaaccaagtaaagttaaaaatttgttaagttttttatttgataatgaacttattactatgaatgaattaacaaatttgtttggaattaagaaagaatttctgatatccttgtttgatttaaaggatgacttctttgataaatatattactgaaagtaaaacgtttggagataatcaatctaatttaattgattttgaacttattcgaaatcaattaactaattagcatttagtttgatgtttttaatttaattaagtttgatatataggaaagagcaagctcctttttggggagcttgctcttttgtgtaacattttttactcttttaatgtatagacatttggtgtaaattggttttgtctctattagactgtatttagaatttgataagctataaaaagatatttgttttgattgtatgaaggaaaaattatgctcatatatagagtaaatattaaaggatttcgtaattatgaagatgtagacgtgtatttaaactctagttcgttgataattggatcaaataatgttggaaaaaccaattttatttatgccttgagactattgtttgatcgaaatctgagtgaaaatgatttagatttattagatagtgattttaatgcatattcacattccgataaggtagaaattactgcatatttaaaagatattaatgaggaatgtcttctaagtgaatttaaggggaatataaatgaaggaaaattgattctaaaatatactaaagaaaagaatcaagattacattctacaggctggtttttcagaagatacaatgcaggaattaaaatcccgaagttatctaagaagattaagtatgcagtatgtagatacaaatagaaatttatataaatacttgagaaaagagagacaaaatttattattgaattctcaagaattattatctgaggaacaaaaaaatgatgacaaaacaaaaacaatagaaatacagaaaaacttaaatagtataaatgaaaagataagttcgttaaactatatcaaaaatgcgcttgaaaatgtaaataaagaactatcctctttatcagttgaaaatgaagatcaaaatattcaatttgttgccggacataatgatgctgaaaagatgttgtcagatgtggctttgtcatattcaagtgaagaaggtcctttaacgttgggtggggatggacgaaacaatcaaatttatttagcaacatggagagctaggcaagaattaaaagctggaccagatcatgtaacattttatgctatcgaagaaccagaagctcatttacatcctcatcaacaaagaaaattggcacaatatttgactaagagtttgaagggacaggtaattgtaacgtcacattctccacagattgcagaaatatttaaggctgaaaatatagtaagattatattttcataacaagtatactgaggctgcttctggacctaatgatgcacaaattaagaattcttttaatgcatttaattatcgacttaatacattgtcggctgaagtatttttttcttacggtgtttttctagttgaaggagtttcagaagttatattctataaagcactagcaaaagaaaacggtattgatcttgatagattaaatatttctatattagctgtggaaggtattggttttaaaccttacattaatatttgtaacgccttgagcataccgtgggtattaagaacagataatgatatatttaagaatagagaagaaaaatactatgctggaattaaacgagcagtaggtattattaaagagtgtaagttagattataaaaaaccatcggaatgtgataaggcctgtgaaaaatggcattgtgatacaataccgaatgatattaagaacaataatgaagcaatgagaaaatcattaaagaatatagggatttatatggcgaaagtagacttagagaacgatatagctaatagcaatctaagtgaagcgctatatgcacattattgtatttttgacaaagacttaaaaagtttagtctctaagatgcagaaaagcaaagctaaaaatatgtttgactttgtagaagaaatgcatagtaagttacaaatgttaaatgatgatgaattaatcgaaccaattgatagtattgtaactaaagtaaagagtcaggtacagtataatggaaagtagcgatgaacaaaaagaaataattaaagataagaataatttagttatcattgcaagacctggctcaggaaaaacgtatacaattgttgaaaaaatacaactaattttagaagatttgtataattaccaggggattattgcaatatcttttacaaataaagcaagtgaagagctaagaaaaagatgcattgataaaggattagcattaaataaatcatttttcggaaccattgataaattttgtttttccgaaataatagttcctttttgtagccatttaagtggtagaaatcaagaacttaagattaagagcttagaagagaatacccgactaagaaatttagataaaaagaactgtaaacatgtgggaaaaattatagaagaatatttgaagcaggacacggtttttctcgagtttttggttgaaacagccttgtatatcttaaaaagagtcccagatgctactaaatacttgcgcgcaagatatagagaaatatttatagatgaatatcaagattgtggtttgaatgaaaataaaatgtttttatatcttgtaaagcaagggattacaggaatggctgtcggtgatattcatcaggcaatttatgcattttctggaaaaaaatctgtctatctagaaaatttgatcaaaaatcctaattttcattattataaactttcagaaaatttcagatgtcatccaagtatatatcaatatgcattaagtttatatggaaattccgaagaagcagctgaggatgataaaagagtttttagagtaaaaattgatggaaatgaaaagaatattgctcaaaaaatcgaagaaaatattcccaatataaagcgccgatataatctaaagtcaactagtggatttgctattttatgtcgaaacaactcaacagttgatatattaaataaaagcctaacaattcctcataaagtatatacgaagacaaaattagatgatgatcaatcagacgtagctcacttatttgtgcaattgattagaggatattttgatgaaaatatatatgcatttgatattactgaacaatatttttcggaaagaaataaaaataataaatatcgaagtttgttgaacgcaacacaaaaattatttgcatgtcccattaataaattggctgaaaatatcactttattctcccatattgctcaaattatttatccagacatagggattgaagatatgtcagaagcattaagtagacttaaagatgtacttaatgataaacatgattatgagaactatataccaccaaaagaagacgaaattagtgtaatgaccattcataaatctaaaggattagaatttaacgtgatttttcagatggacatgtatgattatatctttccgaaagagagttggcagcaaggaggatcggcagaatcatggaaacaagatttaaatttgcattatgtcgcaattactagagcaaaagttgcatgttacttgatggaaggctcacaaagatataataggaaaggaatccaaaaatctgctaagccatctccattttatgatttacccggtttaaaaaagaggagattggacatgaagtggtaatgaagtatatctcgttattgccttagcaattgatccaaataataagcagttgtttagagaagtatttgatgagttatctgatattgtcacggacattaataacgtaactgagctgataaaatgcaaaaattacagtgagtttattattaagcttgtagagttgctataacattaaaaagataggtatatgaaagtgcgagtaggaagctagcatgattttatgtgagattcgcactagaatatacctattttgttgatacaatttatgtagaaatataattgtatatttttgaagcccgatatctagtctagaaaattaatttcaactaaatattgcggtcgcacctcacgcagatacgtggattgaaatggttggctctcatcatggataatgttgctatctggtttgcatctcatgcagattgtcagtttaattggtacaaaaaagcgccaatcaatcatccatatctcatatataaatacttatgagacatttagataaaagagacgccaaaaagtctcttttttgttttaaacaaaattccttcaaaaattccaactatttttgctgattaaatgagcaaaaaagactaaaattaaatagaattaaaagttggagtgaataagatgctttataagcaaattgagcaaaataaacgaaacacatggattattttgggattatatatagttctgctgctagcaattagtgtgtttcttggtgcaatttttacatcatatgttggaatcggtttcttcatcattggcttaatatacattgcgcatgtttattttgatgcaacacagcacctaatgaaggtgacgaatgcagttgaaattactaaagaaactgaaccggtaatttatgagcttgttgaagaactttgcttagcaggtggattgccgatgccgaaattgtacattacgcctgatccagcacctaacgcctttgctactggtcgggatcctgaacatgcaagtttagctatcactcaaggactgctaaacattatggataagaaagaggttcaaggagtgatcggccatgaactttctcatattagaaactatgatacgcgtatcactgttttagccagtgcgctaactagcttgataacaatgactggaatcgggattgtattcttcggctggggcgttttgactagtgagactaaaggaatatttggcttttttatcaaaatcttggctcttattgtaatcgcagttggaggtattatttcaattattggaattccgctagctaaactgcttttcttgcttgtttcaagacagagagaataccttgctgatataggatctgttgatttaactcgtgaacctagtggcttaatctcagccttgtctaagttagagcagctagaagagggtgcagctacacctgagattagttcccaagatttaactttgcagcatttatattttaattttccaaatgcacataactggttgaatcgacttttttctgatcacccaccgttggataagcgaattgaacgattgaaaaatagtgacaaaatcaattaatttaatggctgaccatcattgatgtttggctttttattgtgtaattttagcgattgattgaaactaatgaaaaatgatattatctaaattgaggattgtacttatatcaaggatcttttagtgtgttcttcacgtaagtggaggtgatcctaatcaaaatccattaaacgttctaaagtcaatgtgttctccacatatgtggaggtaatctacaggaccatcgaattctatagaaactaatacaatgaattagatatctcatagtaagaagaataatgacactatgctaaaaaagcgattcacgagtctactatgaaagtagtagatagttaggtggacgcgcatagaagtcagatacgtgcacgtacaaatctcgccttgcttgtcttaaagaagacgatactcaaacgagtgtcgtttttattttagtattttttctcgagaataggacttaaatatttaataaaaataattcaaattatcatcccataactaaatacactaactctacttgttatgaaataaagcattgataagatatttctctttgttgtacagcagcaaaatcatcacgtaaagcaggtttaaagcctgcttccataacaggctaatccgtaatttgaaaactcaattcgttatataatctgtataattttttaactaaaaatgctagaattattgatgtattcaaatagggaggttttttgatgaaaaaaagatatcttttaggagcattaggtttagtacttttgggattgggaacaagtgcttgctctagtcaaagtgataatagtagcagcaaacaaacaactactagtaagtcaaagaagtctgtcgaaaagacagatgaaagcagtagtgagagtacaaaacgctctaaaaaagatttaagtacagcggctgacaatcaagctaataatagtaacagtgacgacggtaaagcttatggtggaaattttcaagatagcaagggatacatagctatcaataatgtaaccaatgtcgttgttaagggttctgatggcgatgaccattatgctctagtgcaaggaactttcagtaataatgctaaagaaagcgttgatccaacatctttctttagtaatcacttaaaagtaatggagaaggttggcaaagctacccatgatcttgttttggtcaccacagacattgaaaatgaattaacgccttggggaaatcagattaaggaaggtcgtaagaaggttgagcctaatatgaccggtaattttgttatagtatataaattagatcctgcaaatggcgctaaaactaatgcaacccattatgtatttgatccttacgattctaaatttggtaaatcattaactgtaaaagtttatgagtctaagaccattaagaaatctagcgataatgcaagcagcaattcacattctgacgaaagtacagatacaaattcaagtgccgatacaagcagtaatgctgatgttgatacagatgactaattaaatattaaaaaactgagaactatgaggggatttcataattctcagttttttattaggtagtattattgtccaattaattgctgaaaatcgctaactagtttttgaaaagttgcatttaaattctgcataaattcattttgattatttttcatttgatctaataatgaatcggcctgatttggattttgtttgatttggtcgatagtagagcccaattgatcaatttgattttgtaaggcttgattattagcagcattatttttcaattgttcattttcagttttgatttggtttaattggttttgtaattcttctttatcttgatcctgcttatatgtgttgatagcactttgcaactctttattttgttgcattaattgtttgttttgctcagacagagtatctaatttactattagtattattaagagcattactttgagcttgctcattttgaaccgtatcattatgagcctgacaagctgaaataccaaagatgatggcaattagtaaaacaagtactccaagaacaatatatactatctttttcttgcctttctttttaggactagcaggtttattaggagaagaagtatatggtgctggttttgctggagctggttgaggagtaggggaagaatcaactacattatttttatccgttacccaggcttgaattttcttggtcgcatattcattattagtaccaattgcggtgataattataggatatacgcctgcttcagaccggttaaccgcctttttatttatactaagattatcatttgaaataagatggccattttctgtaactgtaagttccaattgagagattatttcttgattggtcaaattttgattaagaggccaggtaattgagtctactctggtattgatttgtaatgtcatatctaaattcctttgaaaaattttagtctatttaattcaattatactaataaaatttacttagagaaatgaattaacagcagtaaaataaaacttaaacaattataaactatagaaataatataattaaaattatgtaaaatggagaagaaatgaaaagatcagaagctgtaacattaactaatatgtgtatgataaaagataaagacaaaattttagttctaaatagaactgatccggtttggcctgggttgacttttccaggtggccatgtcgaatctcatgaagcttttcatgattcagtggttagagaaataaaagaagagacgggattagaaattgaggatccgcgtttagttggagtaaagcaattttttgaccataatgatgaacgctatcttgtctttttctatgtagctactaagtttactggtacattaaaagcttctgatgaaggagatttaacttggatgacaagggaagaaatagaaaaatcaaaattagcatataactttgatcatgatttaccaatctttttcgataaaaagttaagtgaacatatcttagatggagatagagatcaaacttattaaaaaagacattcgatcgaatgtctttttattagtcttgagtattttcagttgagctagttgattcagattcattattttgactagctggcgtttcactttccttgcttgaacttgaagaagattcagatgaagcagtagaagatgatgaagtgtgcgaattctcagagtttgaactacttgtagcagaactttgagtagttgcatttgcattactgttagtagtccagctgttatcaaagtaatagttaggtttaggattataataagtataattacgacgtggaacagtatagaaagaagtaccagagttagattttggtaggctactgcttgccttatgttcactgcgttgaataggtaaagtagtacttgatgaactagaactttggctttcagaactagattgctcttctttattttggagactatctagttgatcatccatcttagtgtcttcagcttttttctgatcagttttatctactttttcccttttatcttctttatttttaggtttctctttttcaacttttttatgagattgcttatgagaagactgaataatggcatagtctgctgcagaagatttatgttttggctcaaccaagttgttgcgacaacccgcaagtaataagagactacaacttaaagcaccaacgattaactttttcaaattaatttcctccatttaaaacttcttttattataaccaaaattattaatataaaacagtaaaattaagcgttgataagaaggtatttgaaaaataatatattatttttccagtttgggagctcaaagtacatattttttctagaaaagatataatagatatgtagttaattaatttgttaaatttatttttagataaagatgttggaggtcagtttctatgtatgatcttgaagacgttttaatgaaatcttttagagaagataatggcatcagttcggcattttcaattgagccggttgatgataatgaatatcgtgtttcaactaatgtggttgatggcttgaacgatactattcacttttatttagttgtttatcctaacggaacctatgccttgaatgatcgcgtatttacggcacaaatgattgatgataatatcgggagtttcgcaagtattgccagtgatgtggcacgtttagctagtgaatttggtgtattattagatgatcgcggagaactaacacgtgactatattaatgctcgcgatcttagaaatgaagtaaacaactttactcaattattaaatcgtgtagttgaatttgcccaaatccatagataatttaattacaagagaagaagctgaaagcagaagcttctttttttttgcctaattaagttataatttgaataaaaacaaggagagaactatgaaagattctgaaatagagttaattgggcaaaatgccatgaattggttaaaagaaaatattcattttataaaagctggttcagatattgaggtagcaacacccttaattggtgcatatggggacttagtatattgctggattgaaaaagaagatgattactaccgcattactgatgatggaggaactttatttaagcttgatcccggtcaagaaaatatggatttacttgaagaagcaatggatattgtaattggagctggttttgaatttgatgaagagaccttagaaatttaccaagtggtagatcaagacgatatcccagctacacttaacgatctgactcaattacaggttgctttgacttatttagccagctgatagctttcccatcataattaagtttttaagcatatgttttttgtttttaaaatgcctatgatataaataattgtgaaagcgctaataatgcgtatttcttaaaatattacaaagaatgtaaaaaatatcttaatttgtaacatttttgtaaaactacggtataataaaagtaaataaaacagcaagcttaagtatagcttaccttgctgaggagcgtgaattatgatgagaaaagttaagaagagaagtatcattacaagtttgggtgcagctgcaatgttagcatctttgagtgtaggtggaactgcttttgcagcaagtactacaagtactgatagtagtaccgcaactactgatcaagcaaagacttatcaaactcaacttgaagaacataagaatttacaagcttatactaatccattaactgtccaagctttaactactactaagggtgttttgcctgatgcaacaagtggtatttctaattggagtcaggttccagctggaacagtagctgcttgggataataaacctgaagttaataaggccggaactagttacggaacagtttatgttactttcccagatggatctagatcaagattagcagtttacgtaacagttaaagatggtgcagctagtcaaagtagtgaaaatacaaatactacttcttcagataaaagctcttcagctgcaggaacatcaaaatcaactgctaagagctcacaaatagaaggtgaagctaagacttctgcaaaagacgctgataaccatatggagaagtcaactactgttgagaaaactgataaagatcaagcagcaaaatccagttctaaagctaacgaagatgtagttgtgaaggatttaggatcaactactgttactgaaaaaaatgttagtgttgtaagtaactcaaaggataaggacaagagttcaaatccaatttctgttgctactcgcttaccagaaactgtggctaaggctactaatccatttgtaataatttgcggtgcattaattgcagccgtaagtggtgcagtaatttggagtaaaaaattaaagaaaagaaactaatagacaataaaagaggtcggaactataattgtttcgacctcttttattatttatctttatttttgtccttatctttgctattttgagcttttttctttttaggatcatctggcaagatagcaaatttatcaagcattttttctaattgattatttttttcaaaagttaaacccatatctatctttagctcctttgaattaagataagtgaattataccctataactttaactaaaaaaagtaagctgcatcttataagcagcttacttttttagttttttcgtcttaatttagctaaaaagtcttcatgttctttttctaacttttcatccttatcaataaagaagtagcaggcagccgcaatcactgcaactacagcccctaagagtagtgtcttaggagtaaagttagtaaccatataacaagaaataatcaaagcaataattggaatagtgtattttccaggtagtgaaaaaccgtgtgttgggtattcattactatgcttaaatttaatgactgctaaaattgatggcacatattgaacaaaggatgctaaaactgtacatgaaacaaggaataggtagctttgagtagctaaggctcctgaaagaacagcggtaaaaataataccaacccaaggagcatcgtgtttatttttcttaccaatccatttcggaagcatcccatgttcggtagcaagggatgcaataagtgaaggagtattaaatgaagcactaaaggcaacaccaaagattgaaattaacattccgacaatcataaaagcaaaaccccattggccaacaccagtctttagagcactcgctaatggattagaataacttcctagtttttgcccacttaaaccaattgcaactaaaagcatcaagcaatctagaattgttacactagtcattactgcaattaaaacgcgtggaatattcttttctggattattcatttgctttgcggcaattggaataaaagaaaatccagtaaataaataaaaaattggtgtgaaggcagccccaaaatgtttaaagaatgggccaacaccggttaaagctgcatgtggaattaccggagtaaagtgagctttcttaataaagaaggcccccacaataatgaagacaagtaatgtaataatcttagctgcagctgaaatgttattaacaatttttacccaagatctaccaaagaaattaataattgaaaacagtaaaattaagaagataactccactaatgtagactgcattatttttaaaaataggtagaaaactctttagaatggttaataaagcaactacttcagcagaaagagttgtacatcctaaaaaccaagtaaaaatacctagttcataacccgaaaaacgcccaaaagcattatatgaataaagccaagcggctccggattgtgtgaaacggctggataagtcagcatagcataaagcaatcatgctgacagtgacagcagtacagagaagaacaagaatagctgttaagttcatgtaacgataaattacagaaggtagcaggaatgtccctgatccaatgactgcattaatacctaagaaatagatagatataaaggaaagtttcttaggtacggaacttttattagtcatatttttacctctctatctaataatgttctcctttatctattgtagtgctttcgaatagtaaatctatacgaaatattcaaaaaagataataaaattgatcttaagtagttgacttattaataataagtaatactatgaaattgtaagtgaggatagctaggtaaggagaaaatcatgactgagattattcaaatttgcactgtagtcaaataaatatgtagaacttttcattaaaattattgattttgtgatgcgaggaaaataaaaatgacaaagattgctattttaggtgctgctggtcaaattgctcaattagttgaaccaatgctattaaagaagacggatgtagatatggttttatatttgcgtcatcctaataaattacatcaagttgatgaaagtcgagaagagataatcaagggtgatgcaagcaactttaatgaattaaaggcagcattagcaggtgttgacctagtttacgcaaacttagctggggcaaacattgaagatcaagccgaaactgttgttaaagcaatggatgcaaatggcattaagcgcttaatttgggtttcttctctaggaatctataatgaagtaccaggaaaatttggtgaatggaataagaatgttttaggttcttacttaaccacttatagagcagcagctgataagattacagaaagtgatttagattacaccattattagaccagcttggttaactaataaagatgaagtaagttatgaaaagactgttggtgctcaaactccattcaagggaaccgaagtgtctcgcttgagtgtagcagactatatagttaatataattgaaaatccagcagaggatcttaagagtaatgttggtttagataagcctggaactgacggtgataagccagcctggtattaaatttaataataagaaaaaagaacggtttttaaaccgttctttttggtgtaaagggagcaagtttaagcttatctagttgattgcgataataagtcaaactcttacgattacaatgtaggatttccattaatttcaagtcagagaggctagggtcatttactttatagtaaatgtaagaaaggcgaagttttcctggggtaagatcaaaatttaaaatgtccttgtctggagcaatttttctagttaaagaggttaaggcagagatttgtttaccggtctttgtttgaaaaataagaggattttcttcagtattagtcaggagaatagagcgatagtttgaatttttaatacttgaaatattagccttacttaaattaagaaattgttttgggtcaaagccgtgagcaatcaaaattagaacttttttgcaatcaagactaatttcaggccaagttataatttcatcaatctgatcaatccaatcaatacaaatatgcggagttcgatcaaaagtatagccatgtaaatcggtaaaaagataatttttaactaattggtggtcatagagaaaagaaaaatatttctttaaatgggtaacatacttattaatcgtactaattgttttattttgatcttgctctaagtggtcaataaaggcgcggatatcttgagcagaaacattactaactttaggttctaaatttgaattttgtaaaaaatagttccaaaaataatagatcgattgattaattgaagtaattgttcgcggcgcaagattttgactactgcaccattgattaaaatttttttcgtagggaaatagcatttttatacctcattaacaaaaatgtaattgttactttaacatatatctaattataacaaaaaaggttggcgaacttccagtccgccaaccagtatatagcaaaattttacttcttaattcgagatttgtaccatttaattccaaagtaaataaatagaattagtaaaaggataataattacgattgtgtaatcatcaaagattctaactacgacttgccaattctttcccatatagtgccctaaaccaactaatacactattccaaactaaactacctaaagtagtcaagactagaaatttagtccagccgacatgggcaatacctgcgggaattgagattaaacttctaacaacagggatgcaacgtccgtaaaaaatggcgccaattccatgtttgtcgaaccaatcaatggctttttgagcatcatcttttttaaatcctaaaagtttaaataatttagtttcaagtaatttttcaagtcgtggcagtgttagattacgacttattgaaaatagaataatcgcaccaataattgatcctaaagttgaagctaggataactccgattagagttaatttagttccactaactaggaatcctccaagggtcaaaatcacttctgaaggaataggtggaaaaatattttcaacggcaattaaaagaataatggcaagatagccgaaattttcgataaagtgtgttaaccaaattgtcatttatatatttattgtctttctaaaattttatctactttcttaaagaataaatctttatctgcttttgttacttcagtaatttcttttccattagggtcgataaacatgcgaccacttgctaaccctgatgtaataacatttgcttttacctgacgtgtctcaacaagttcagggtagagagctgacatagtggttaaaacgtcccacaaatatagctctgcatttggaacagaaataattaagctgtatcctaaaccaactaagtcaatagctggatactttcttaaactagcccagtgctgacgaagttcatcagttaaaggaagttcttcggtactttctaagccgaccatttgaattttaagatcggaatctagaactcgtctcactgcatccggatcccaaaaagcattccattcttgagtgccgtcagcatcaacgctaactacgtttccatgtccgtccagagagccacccatccagtagactttttcaatttttgattgaattgaagcatcttcgtctaatgctcgagctaaatcagtgattggaccagtcattactaaggtaacgggaccatctgcttttttaattttatcaatcatatctaaatgagcaggcaacgcagcttctggggttttaatttcaccgctctcatttaagattggaaagtagttaaatgagtatgttgccatccgccactcttttggaaattgatgaacagcacgtgaattagagcgagcaacttctaatttatcaccacgtaaattgaatctatcgaccattttccgacaagcttccactgagggatcgatatatccatcgccatcaatggcactaattccaatgagtttaatatcaggcgcttgcaagagtaaaagaagtgaaactaaatcatcgatgtttccatcatgattaaaataaatatttttcattatttgcgacctttctttttggctatttactattctataagaaaatgaaggattgagtaaacaaaaaagtcatcttacttggttttaagaaggaacgtgataaaatactatgggaattttaataggaaggaaaaataatttatggcaacggaacatattgaaaataaattaaaacttttgccggataagccaggttgctacttaatgaaagatgttaacggcaatgtgatctatgtgggaaagtctaagaacttaaagaaccgcgttcgttcctattttaagagtaaacaggtggggagacgtgctgaacttgtacgtgaaatacgtgattttgatatcattactgtctcatccgataaggaatcttttttgttagaaattacactaatcaaaaaatatcagccttactataatgtccaattaaagcaaggtacaggctatccttacattgaaattactaatgaacgtgatccccaaacacgtttaacatcaattgttcataaggatcacggttactattttggaccttatccaaatgtttatgcagcgcaagcaactttgaaatttattcaaaaagtctggcccctaagaagatgtaccggccatcaaggacgtccctgtctttactatcacatgggacaatgcttgggagcttgctttaaagaggtgccaaagagtacttatgatgctcagattagaaagataaagcgatttttaaatggagacattgctcaggttaagcaagatctgacagaaaaaatgacacaagcttcaatggatctagaatttgaacgtgctgctgaaattagggatcaattgaaatatattgagcaaactgttgagaaacaaaagattatttctaatgatcatactcaacgagatatctttaatttttatgttgataagtcttggatttcaattcagattttctttttaagacaggctaagttactacgtcgtgaaacaagactatttcctttaactgatactaatgatccacaagatgcttttgtttccttcattgctcaattttacggacagcgcaatcgtgtcttaccaaaagaagttttagtaccggctggaatggataatgaatctttatctgaagtgctaaaggtaccagtaagaacaccacaacgtggtcaaaagaaagccttgttagaaatggctcatgacaatgctaagttgaaactagatgaaaaattccgcctcttagaactaggcaatcgtaaaactaagggtgcgcaaaaagaaatttttgacgctttagggctgccgtatggacatagaattgaaagttttgaccactctcatattcagggagctgaccctgtttctgctttggtagtatttactgatggtgaagctgataaacatgaatatcgtaaatacaaattaaagggtgaggttgaacatcaaaatgcggctgatgaagtaggaaacacccgtgaagtagttagaagacgctacagtcgacttttaaaagaacataaaaaaatgccagatcttattttaatggatggtgggcaaattcaagttgaagcttgtttggatgttttaagaaatgaattgaatgtaaatattccggtcgccggaatggtaaaagatgatcaccaccgaactaatcacttgatttttggtgatcctacaaagggagaagaattaaagctaattcctttagatccaaaatctgagggattttacttaatgactagaattcaggatgaagttcaccgctttgcaattacttttcatcgaagaacccatgccaaaaatgctctttcaagtaaattagatgaaatcaagggtattggtcctaaatctagaaataagcttctaagaaagtttggttctttaaagaaaattaaagaagcatcagtagatgaattaagagaagctggtttaactcttccacaagctcaaactgtaaaattgagtttataaattaaccaataaaagacctgatttaatggggcttgatatggtattatagttaagaaactttaaggaaatttttaattataaattgatatataaaggaggcacacataatgtttgtcgaccaaacaaaaatagatgtacaagcaggaaagggcggcgacggtgccgttgcttttcgacatgaaaaatatgttccacttggtgggccagccggtggagatggtggccggggaggtagtattatattagttgctgactccggcctaagaaccttaatggatttccgctttagacgtaagtttaaggcagataatggtgaaaatggtcgtattaaatctcaatatggccgcggagctaaagatgtaagattaaaagttccaatgggaacaagtgtctatgattttaatactggcgagcttttgggcgacttagttgaaaatggtcaagaattggtagtggctcacggcggaaaaggtggtagaggtaatatccactttgccactccaacaagaactgctccagaaattgctgaaaatggtgaaccaggagaatttcgtactttacgcttagaattaaaggtcttagctgatgtcggactagtaggtttcccatctgttggtaagtcaaccttgttatctgttgtaactaaggctaagccaaaaattgctgcttatgaatttacaactttaactcctaacttaggaatggttgttcttccagatggccgtgatttttcaatggctgacttaccaggattaattgaaggtgcttcaaaaggtgttggacttggaattcagttcttgcgtcatgttgaacgtacaaaagtaattctgcacttagtttcaatggatccaaataatggccgagatgcttacgaagactatgagacaattcgtaaggaattagcaggttacactaaggacttaactacaaagaaagaaattattgtagcaacgcaaatggatattcctggtagtgaagaaaaatttgcggaatttaagaaaaaactaggagataaaactgtctatcctatttctagtgttacccataaaggtgttagtgaactaatgggtaagaccgcagatcttgttgaagaagttgctaaagaagaagctgaaaaaccagcagaaatcaaagttgccgaaaaagaatatgtttataagaaaccagaagatgaaggctttaaggttgaaagaacaggcgaacacagctttgttgttacaggcaataagctagagcgtcttgttcaaagaactaaccttgaccatactgatggaattatgcttctagctcgtaaattaaagcgcttgggtgtagatgaagctttaagagaaaatggagcagtaactggcgacgatgtttcaatagctgactttacttttgaatttgtagattagaaaatttgaaaaagttgggagtaagacttttgaataaaaagaaccgctttattacaggttatgccggacttcgtgctctagccgttattggagtaattctatatcaccttaatccaaaccagtttatgggtggatatttaggagtaccgatatttttagtattatcgggttatttagttacagaccatatgtttcatgcctatgaggagcggggagagtataatttcaaatctttctacatcaggcgaatcaaaaaattataccctcaaatgattacactgttgtggggatgtagtgcctatatcttactttttcagcagaatcttctagctaagttgaatcaaatagtcgttactaatttactgaacgtctataacttttggcagataaagaatggacaaagttattttgaacgatttgcagctaatgaatcgccatttgttcatttatggaccatgtcaattgaaggtcaattttacattatttggcctctaataatctttttgctagttaagttcgctaaaaagaaaaaaacaattttttggattattacagccttaactttattttctgctttagagatggcatttttatttaaaccaggtgttgatacaagtagaatttactatgggacggatacaagattcttctctctaggtttgggagcaatgctagcagttttttggccaacttggaagttaaatgcaaatctagaaaaaagagatcattggctcttaaatattgtgggagctatatcattagtagctatcttactaatggcaacgagtccaatttttaatccacaaaaagcatttgcctatcgtggagggatgttcttcttttcactagtaacaacgatttttgttggaatcattgctcatccaggcagtagctggaacaagtggttaactaatccagtatttaaatggattgggtcacgttcatatggaatttacttatatcaatttccagtaatgattttctttgaagataaggttaaagatattgccgatcatgtggttttatatcattcaatcgaagttattttaattttgataattgctgaacttagttatcgttttattgaaaaaccatttggtcgaattgattgggaaaaggttcgtcaattcttaactaaggccttaaatttacgagcaaaacactatcaagcaaagatacttttcgcaacagggataatagtttttattctaggtagttttggaattttaaaagcgccaactgtcaaagcggaaaatcctaatcactctcaactagctaaacagattaaatcaaatcgtagtaagcaactaaagaataatcagaaactaattaaagaagctcagtctagaaagaaaaaagcaccaacttcaagagctgatcttataaaacaagctaagaaagcggcagttaccaaaccggtaaataaagactttgaaaaatacggaatttctcaagttgatttacaactagcacaaaaaattcaggtgactgccattggagattcagtaatggctggatctagccaaaacttacaaaaattgatgccacatttaatcattgatgcagcagtttctagacaattgggtgatactattccactttttgaacaatacaaggcaaagggtgctttaaatgataatgtgttaattggcttaggtacaaacggatcctttcaacctcaagaacttgatcacttaatgcagattattggcccaaagagacatgttttttggattaacactcatgtgccaacacgtgattggcaagatcaagttaatggtgaactagatgcagcaacgaaaaaatatccaaacttaaccattattaagtggcatgaatttgctggtagtcatcaagattggttctacgatgatcatacacatccaactccagaaggatcgaaattttatagtgcctatataactaaagttttagttactgaaggaaaatattagaaatagggttttcatggaaatacaatttttaggaacaagtgcgggacaaccatcaaaaagtagaaatgtttcttgtatcgcactaaaattattagatgaattaaatgaagtatggctatttgatgtgggagaagccacacaacatcaaattttaaagactaacattagacctagaaaagtaacgcgaatctttatttcacatactcatggtgaccatatttttggacttccaggttttctctcatctcgttcttttcaaggcgatggtggtccactaacaatttatggaccagctggtattgaacaatttgtacaaacttctctcagagtttctaaaactcgcgtatcatatccgattaagtatgtggttttaaaagaagatggcttaatttttgaaaatgatatttttgcggtctacacagctcgtttagatcaccgagtaccgagttttggctttcgtgtagttgaaaagccacgtccaggtgaattattaatggataaagtggcagaatacaatgtgcctaatggaccgcttcttggtcaattaaaggccggaaaaataatcacattaagtgatggtcaaaaactagatggacgtgattttcttggagaagagcgtccaggacgaattgtgacaattatttatgatactcggccgacaaaaaatattggtgaattagcagataacgctgatgttctagttcatgaatcaacatttgatggtggagaagaaaaaatggcccatcgctacttccattcaacttgtttggatgcagctcgagttgctcgagatcataatgttggagagctttatttaactcacatttctgctcgctatactggaagagctggtagacaattagaacatgatgctagaaagatttttaaacatactcacttagctaatgatttagataattttgaaatcacattgaggggataataatatgagtaattcattaagggataaagtcgtagtagttacaggagcttctagtggtattggacgctcaattgctttagaaagtgcaagtcgtggtgcaacagttattttgatggcacgtcatcaagataagttagaagaaattgccaacgaagcacgtcagctttctggaaatgaagtatatgtatttccaacagatattagcaaagctgatcaaattgatcgtgcctttaatgaaattgttagtcatgttgaccatattgattatcttgtcaacgcagcaggttttggtgtctttaaagaatttttagagacttcacctcaagtggtgactgaaatgtttcaaaccaatgttttaggcttgatgtatttcactcgtcttgttgcgcgcgtcatgatcgatcaaaagcaagggcaaattattaattttggctcaattgctggaattgtaccaactactaagactgcagcttatagtgctactaaggcggctattattcaattttcaaacgttttacgtctagaattgaaaccttttggtgttaaggtcatgacagtaaatcctggaccagtttatactaatttctttaatattgctgatgaaagtggttcttacgtgaataatgttcaacgtttcatgcttgatccagatgatgtagcttggcaggtagtccacttctttggctctaatcgtcgtgaattgaatttacctctaagcttagctaccttagcaaagctttaccaaattttccctcgtattggtgactgggcaagtctaaagtttgctagcagaaagtagggaagaatgatgaataagcaaagaaatttagtaattggactaattatcgttttagtgcttgtgatttttgcatgcctaaatactgaacctgtagcgattaattttggctttttccaacctaaaatgcctttaatcatcgtcttagtgattatgcttctattaggtgctttagtatcacttttgattggcaaaggagaaaaagtttctcccgatgtaaaaaaagcactagcaaaacagaagaaagaattagataataaatatcggagtgaaattgaatctagagataaacaaatagctgaattaaaaaaagttaataattctgaagctacaaaataagattggacttgatttatcagctcttagattgtatcattgaaatacgtgagtatttagtgaatttgtttatttaaaggttcgcaagtctcaattctataaaaaaggagatctaactaatggcagttcctgcaagaaaaacttctaagcaaaagaaacgttcacgtcgtggtcatattaaattaaccacaccagcaatgcattacgatgctactactggtgaataccgtttaagccaccgcgtttcaccaaagggcttttacaaaggccgtcaagttgctaacgaaaacaagcaacaaaataacgattaattaaagacaccttggggtgtctttttttatataatttttgattaaaggaataggtattaatgaaactagttattttacactcaagtgatacgcatggctttttaatgccaactgattatcaagataaaaacaattatgatgcaccaatttcacttagccgggtaagcagtgttgtaaaaagtgaaaaagaaaaatacggcgcaaataatgttttagttacagatagtggagattgtttgcaaggatctcctttagctagctttacacataagctccttgaagaggaaggattacgcaaatttactgaagcgtataacgaagtaggctatgatgcacgtgcattggggaaccatgattttaattatggattagattacttgtcatattacgtggataataaccgtgctccgtttattaatgacaatgttttagatgcagaaactaatgtgcctttttttggtaaagaatacactattattgaaaaggctggcctaaaaataggaattatggggattactacccaatatatttctcactgggaatcagaagagcatatcaaaggattaaagtttgtttctggttatgatgtactttctaaattagctaagaaattgcgcccacaggtcgatattctttgtgctatgtatcatggtggctttgagagtgatcctttgactggggaagcaactgagccccacactggtgaaaacgaaggatataagattttaactgaaattcctgaaattgatgtctttttaactggacatcaacatcgtcgcttaaacttagttacccgggatactgcaattgttcaacccggatatcgaggagaagcggttggtaaagtagttattgattttgacaaggatgaaaaaggcaaggtcaagattaatgagatgactactgaattaattgatagcaaagattacgcccctgatccagctattgaaaagattgttaagagccttgatgaagagactcaaaagtggttagatcaacctattgctcacttatctgagcctgctccaattgaaaatgcaattcaggggagaattgagggagctccattcattaaccttatccagcaaatgcagctttggtttactggtgcagatgtttcagctactgcaattatgtcagaatcagctcatggattttcaaagaatgttaccatgagagaagttttgcttaactatccatacgcaaatcaactttgcattgttaaccttactggaaaagaattaaaggaaatcattgaatattcagctggctttttagaaaaagataaagatggtaaaattaaatttatcgatcgttggattacacctaaaccaatgttatatcattttgatcttttctatcctgttaagtacgaagctgatttatctaagccagtgggtcaaagattgactaaggtgactttagatggtaaagatcttgaagatgacaaggtttataagttagctgtgaacaattatcgtgctctcggtggaggtttctacccagcttacagtatggataaaattgaaaagatctttgaccaagattatgttcaaatgtttagtgagtacttaactcatgataatattaaagtagatacaagtaagaattataaattttactaagaaaaaaagctgtttcttaattgaaacagctttttataatattcaaatttaattcaattataatttactatacttacttttgtctttatgacttttggcagtaatggcaggaataataattgcgaagagcaagccaaagactgcgccaataatcaaagattgcataggattaaattgcatcctgagttaaagatgcagcaataaaaccgataatttcgcaaaaaatgcatgaccaaatcactgtaataatgtagcgcataatttctccttctttcgctaggtatcttagcaaaaataagatgttttagcaagcgaagataatagaatttgctatacttaaattatcagaaagggtgagtatatgggagcggttagtttacaaaatttaagcggttttactctacttgagagtccaactaaagttaaaaatttagctgaaaatgctaagaaaaaaggctattctgcgattgctttaaccgatatcaatattacttatggcctggtcgatttttataaggcagcaaaagatatcggaatcaaacctttgctagggatgcaacttagaattaatggcttaattgatggagccaataagtatgatctcattgtaattgcaaaagatgaccagggatatagaaatattttacgtttatctagcgcagttaatcttttaactgaaaatggcgaaaaagaaattgttctaactcttgaagatctaaaaaaatatctagggcatttaattctaattactccaagcaatttacatagtgaactaaaaatgttgcagactaataatcccaaggtgggagcaaactatttgcgaaaggcgcaagatcttcttcctagttcatcttccatgtatttaggagtctatgctgattcaggccagcaagaatatataaattatattcgctcattagcaacacaatttaacttacctctaactgctgtagaagatggacagtatcttaaccgtaatgagcaatttttaagacgtacgctgcaagcaattaaaactaatactcatttagaaaatatagagcagctagctaaacaagcaggctcacactatttgaaaaatagtgaagaattgcaagtgatttatcggaagtttgatattgaagatgcgttaaaaaatgcagaagaaattggaaaaatctgtactgcagaaattaaatttcaagatccacaattaccaaaatttaagcaaaataaatttcctacctcaaaagaatacttgcattctttggctcaaacgggtcttgcaaagagatttaataaccaaatccccactaaatatcgggaaagacttgattatgaattacaagtaattaatgaaatgggatttgatgattattttctcattgtgtgggatgtaatgaattttgcacatagtgtccatattacaacaggtccagggagaggatcagcagctggatctcttgtttcttatgcccttagaattactgaagtggatccaattgaatataatttgctgtttgaacgtttcttaaatccggctcgtcagcaaatgcctgatattgacttagatattccagacaatcggcgggatgaagtaattaagtacatgtttgaaaagtacgggatgaatcatgcagcccagattttaacgtttggtactttagcggcaaagcaggttttaaaagatgtttgtcgtgtttttggattaaataaggtcgaaacctatcgttggttagatgccattccgcactctaagggaaaaatcaccttagctgaggcctatcaaaaatcaaaagaattgcagctactagtgaatacgaatgaattgagtaaaattttatttgcgaccgccgagcatttagaaaatttaccaaggcactattcaattcatgcggctggtttagtaattactgatgattccctagctgaaatcgtaggacttcaagcaggtcccctaggaattcccgtaactcaacagacaaaatcgaatgttgaatcactaggtttgttaaagattgacttcttgggattaagaaatttaacgattttagggaatattgttgcagctttaagagcggatggaattaacataaaccctaaccacattcctctggatgatcaagaaacacttgacttgtttcaacgcggggacacggatgcagtgtttcagtttgaatctgatgggattaagcgtgtccttgaacaacttcatccagatagttttgaagatattgttgcagttaatgccttataccggcccggtccaataaataatattgatcatttcatcaatagaaaacatggaaaggaaagggttcaatatcctgaccctagtttaaagaaaattttaggcactacctacggggttttggtttatcaagagcaagttatgcaaacagctcaagttttagcaggtttttctttaggagaggctgatctgttaagacgtgcaatgtctaagaaaaatgcggatgtaattcagcgtgaacgagctaagtttattgaaggtgcaattaaattaggccgtaaaaaggaaaccgctgaaaaagtttatgactacattgcacagtttgctaattatggatttaatcgttctcatgccgttgcctacagtaagattgctttttggcttgcttattttaaagtgcattatcccggagccttttatttagctttgttaaacagcaatatgggtaatcgaaataaaattgctcaatacctaatgcaagctcaagaagctggaattaagattttgccacctgatattgaaaatagtaagacagatttttcattagagaatggaaaaattttagttggattaaaggcaattcggggattaagaagcgacttattgaagcaaattttagaaattaagcgtccaattaagtcgatgaccgattttctctggaaaatagataataatttgctgagtgcagatgcggtcgaaaatttaatcaaggctggaacttttgatcgactagctcctaatagaaatgaactgttaaaaataaataaagatttagttgagagtgtaaaaatggcaggctcaaatttatcgttattcgaaacattagagcctaaagtagaagaagaaaaaatgccaactgcagctgaaaaatcagcgatggaagttgaagctatgggttttagtactggcattaatccgattattgcggttcaaaaatatgctcgaaagtttaatgcaaaacgattacaagtttttgagagtaatgaacaaggaattgcagttggaaagttaataaaggttaaaccaattaccacaaaaaaaggtgataatatggcttttgctgtttttagtgatactagtggcgaaaaagactttactatttttcctcaagtctgggaaaaagtaggtgagaacttgaagattggtgagatatatttacttcaagttaggacacaaagtgatcgttttaaccctaacaaaattcaatttctactttctaatgctcggcaagttaattttaaagattaattcaatttttttaaaagcaagcaaaagagagcctaataaggttgaaagcgaaaacatttattttataagaattattagtgaaaaaataggcttttttttgaagacattgagtaaaaaaaatggtacgataaaatcgatgtgagtaaaacacagaaaatcgtagaggtgaattcatgaaacggattggtattttaactagtggtggagatgcccctggtatgaacgctgccattagagctgtcactcgtacagctttggcaaacggtatcgaagtttgcggaattcgttatggatatgctggtttagttgctggtgatattttccaaatgacttctgaaacagttgcggataaaattagccgcggcggtacttttctttattcagctcgtttcccagaatttaaggaagaagaagttcaacttaagggaatcgaacaattaaagaagcacggaatcgatgctttggttgtcattggtggtgacggttcttaccacggtgcattgaagcttacaagacatggctataatgctattggtcttcctggttcaattgataacgatattccttatactgattacacaattggttttgacactgcatgtaatactgcaatggaagccattgataagatccgtgacactgcaacaagtcaccaacgtgtatttgttgtaaatgttatgggtcgtgattgtggggatatcgcaatgcacgttggtgttgctaccggtgctgacgcaattgttattccagaagaaccttatgacattaaggaaattgctgaaaacttgaagcaaggatttgctaatggtaagaaacatggaatcgttgttttagctgaaggtgttatggacgctgaaaaatttaaggatgaacttcttaaatatggtgactttgacgctcgtgctaatgtattgggccatatgcaacgtggcggaagcccaacaatgcgtgaccgtgtagtagcaagtgaaatgggtgcctacgctgttaagttattacttgaaggtaaaggcggcttagctgttggtatggaaaacaacaagcttactcaccatgatattcttgatttgtttgatgcaaaacaccacggtaattatgcgttatactcattaaacaaagacttagccaagtagtttttgattttgtattataggagattttttcaagatgaagaaaactaaaattgttagtactttagggccagcctcaaacgatgttgagactattactaaattagctgaagcaggtgcaaacgtattccgtttcaacttctcacacggtgaccacgaagaacaccgtgcacgtatgaacatggttcgtgaggttgaaaagaagactggtaaacttcttggcattgctcttgatactaagggtgccgaaattagaactactgaacaagaaggcggcaagttcactattaacactggtgacactatccgtatttctatggacgacactaagaagggtaacaaggacatgatccacgttacctacgatggtctttacgacgatactcacgttggtggtcacgtattaatcgatgatggtttagttgaccttttgattaaggacaaagatgacgctaagagagaattagtttgtgaagctcaaaacactggtgtaatcggttctaagaagggtgttaacgctcctggcgttgaaatccgcctcccaggtattactgaaaaagatactaacgatattaagttcggtttgaaggaaggtatcaacttcatctttgcttcattcgttcgtaaagcacaagatgttcttgacattcgtcaattgcttgaagaagcacattgtgaatacgtaaagatcttccctaagattgaatcacaagaaggtattgacaacatcgacgaaatcttaaaggtttctgatggtttaatggttgctcgtggtgacatgggtgttgaaattccatttatcaatgttccatttgtacaaaaagaattgatcaagagatgtaacgctttaggtaagccagttattactgctactcaaatgcttgactcaatgcaagaaaacccacgtcctactcgtgccgaagttactgacgttgccaacgctgttcttgatggtactgacgcaactatgctttcaggtgaatctgcaaacggtctttacccagttaaagctgttaaggctatggctgaaatcgacatgcgtactgaaaagcaacttgctaagcgtaacaagttagctcttcaaagattcgaagaatacaagggttcaaacgttactgaagctatcggtgaatcagttgttagaactgctgaagaattgggcgttaagactattattgctgcaactgaatctggttacactgcacgtatgatttctaagtaccgtccaaacgcagacattattgctatgactttcaacgacaagattcaacactcattaggtgttgtttggggtgtaaagccaatgttgactgaaaagcctaagtctactgaagaaatgtttgaaaaggcagctgaacttgctaaagaaactggtcttgcaaaagacggtgacttagtaattatcgttgctggtgttcctttgggcgaaactggtactactaacttgatgaagttacaattaatcggtacccaacttgttaaaggtttaggtgttggtgaacaatcagttattggtaaagctgtagttgcaacttctgctgaagaagctaacagcaaagttcaagatggtgacatcttagttgctaagactactgataaggattacttaccagcaatcaagaaggcttcaggtatggtagttgaagcttctggtttaactagccatgcagctgttgttggtctttcacttggtatcccagttatcgttggtgctactgatgcagtagaaaagatcaaggatggttctaagattactgttgatgctcgtcgcggtgctgtttaccaaggcgaagcaactaacctttaatctgaattaaatagcttattaaaatagtcagcgaaagctggctattttatttttgtctttttttccttatactataagatgatagacaaaataaaaggattgaggcgctattatgttaggtgaaataagaaaaggaaaagttactgatgaaaatgaatctgctttttatgtgcaggttgaaggggtaacttttgaattaaagaaaatagaaattacacaagatgaaccaatccatttaggtgatgaagtacaaggctttatttatgaaaataaggataaaaagaaagaaatgacacaattttatccttttgctcaaaaagaccagtatggttgggcaactgtaacagaagtgcgccgtgacttaggtgttttcttagatattggtttaaatgataaagatgttgttgtatctttagatgatcttccacttgaaaaggatcaatggccaaagaaagacgatcgcttattagtacgtcttgaaactgatgaaaaagagcgtatttgggctaaaatggctgaagaaaacgtctttgagcaattagctgctaatttcccagcacatttagagaataaaaatatgtccggaactgtttatagaaattatgaagtaggttcctttgtaattactgatcagtactacttatcctttgttcataagtctgaaatgtttcgtccattacgactaggtcaaaagattaagggacgtgtaattggagttagtcaatatggtagattgaacttaagtgttcttcctcgtggatttgaagaaattgacgatgacgcacaaatgatcttagtaagtttacgtcgtgaagctacaaaaactctaccattttacgataagagtgatgcccaagagattaaaaatcactttggtatttctaaatcggcttttaaacgtgcattgggacatttattaaaggatgggttaattactgaagataaagatgcaggaacaattagcttggtagaaaaagatgactcagacacagataatgaaggataatttagaagattatttacgatttagtcaagtagaacgtggcttaagtcccaatacgattgtttcttaccgaactgatttagaagaatatttaagttatttagaagatcagaatgaaacaagttgggaagttgattatctagtagttgatgcttttcttgcaacacaaaaagataagggaaaagccacaacttcaatcagcagaatgatctctagcttacgaaaattttatcaatggcttttgcggcaagatataattgaacgtgatcctttagttaaaattgattcacctaaaagcgaacgtagattgccgacagctcttagtgaggaagaagttactaaattgttggatgctcctgatactaatactcgtttggggattagagatcgagctatgcttgaagtgctctatgcaactggaatgcgggttagtgagttaattaatttacgtactggcgatattcacagtgagttaaaaattattagagttcttggtaaaggatcaaaagaacgtcttgttccgattaccgaagttgctttatcatggttagagaaatatcaaaaagatgtccgagagaatcaagtcttaaaaagcggtcaatttactgatgtgattttcctaaataatcatggtcatcaattgacgagacaagctgtttggcaaaagataaaaaaatattgtcaacttatcggaataaccaaaaatgttacaccacatactcttagacatacttttgcgactcatttattagaaaatggggcggacttaagagtggttcaagaaatattgggccatagtgatattacaactacgcagatttatactaatctgacgcagaaacatattttggaggtttataatcaagcacatccacgtgcctaactattatgatcagcaaatataaaaaagattacgaaaaaactgtaatgggatatttatcttatctcccagattttaaaaatattaagaatctgcaagaagagatgaaactgtatactagcgattccaatcaattcgaggttcttatctatcaacaagatggtaatgctcgcggtattgttggtattcaagaagagaaagattttattattatccgctatttatctcttgatccaacaatgcgtgatgaaaaaacaaagcaattggtaatgaatgacctaaagcatctttatcctgataaaatgattactgccttacctaattgggcatctttattaaattatttaaaggaaaataaaactgatgaataatgttgatgaattaactttagatcttcctaattttacgggaccactcgatttacttttacacttaatcagatcacaaaagatagatatctatgatattccaattgcaaaaattacgggacaatatttagctaatttagctcgctggcaaactttggacttacaaattgctggagagtattttgtgatggcgtcaacattacttagaattaagtctcaatatttacttcctaaaaatgactttattgaggaagatcagtatcaagaagatccacgtactgaacttgttgagcaactagtccagtactcagtctttcaaagaattgccgaatactttaaaaaaagagatgaagaaatgccaattacagtggcaaaggatccatctgtttcccctaaaaaagagattgaaccacttcctttaggagaaattacaagtgatgagcttgcaaatacttttaaagtagttttagagcgattcaaactgagaaagccacaagttggaaaaattgaggttcacgagacttcaattgaagaaatgacaagctttttaaaaaacaggttacaaaagaaaagatcgactagtttttttgattgtattaaaagctttcaagatcttgatcaagtaattggtttattcctagcagttttagaattatgtcgtgatcataaaattttggtaaagcaaaatagagattttggtgatctagagttagagaaagttgagattaatggcaagtaaagaagcagaattagaagccttactttatgcagcgggggatgatggtttagaaactgagaatttactacagttgttagaaatttctccagctgccctaagagaattagctaatcatcttaaggaccgattgaaaaatgatgaaaattcaggtttgcagttaatttgcatcaatcaaacttataaattaaccactagtccgaaatgcggagatattatttctaaatttttccaaaaagatctatctaagaatttaagtcagtcagcgcttgaaatcctgtcgattattgcgtatcgacaaccgattactcgagttgaaattgatgacttaagaggggttaactcagcgggggctttgcaaacgttggtttggcgcggattaatcaaagtagatggaaaaaaggatgtcccaggacatcctaacttatatgtaacgaccgattattttttacagtactttaactatgaaagtttggctgatttaccggtaattgaagaatttgaagccgatgataatcctgtgaacctatttaatcaggatgatagtagaaataaagaaattaattttgatgagggtgagtaaaatggctgaaagattacaaaaagtaattgcgcaggcaggtgttgcctcaagacgtaaggctgaaaagatgattagtgcaggacaagtaactgttaatggtaaaaaagttactgaactaggaacaaaagttgaacctagcgacaagattgaagtaaatggagttccaattgaaaaagaagccctccacacatacttattttataagccacgtggcgtgatttcttcagtaagtgatgataaaggaagaaaaacagtagttgatttctttgaggatgtaccatatcgcctttatccagtagggcgtcttgattacgatacatcgggcttattactaatgacaaacgatggtgaattagcaaataagttaatgcacccacgtaacgaagtaccaaaggtttatgtagcaaagattaagggaatcctttctccagaggagattcgctctcttactcatggtgtgcgtattgatggacgaaagagtgcaccagctaagttaaagattctaaagactgatgagaaaaagaagactcaaattgttcaattgactatccatgaaggtcactaccaccaagttaagagaatgtttgaagcagtacatcactttgtagaaaaattagctcgtgaaaagtatgcctttttaactttaaagtcattaaattcgggcgagtatcgtgaattaacgaatgaagaagtctttcgtttaaatcacttagctgactaacgctttattaaaagctatgataaaataaaactaataatctataatttggaggacttttgaatgaaggaaaataaatctcaggacaataaagaaccaaaaggcccttacaagcattttgagcgtcctaaaacatctagaagggcaatgcatcatcgggagtcagaaccagaagcagagccagaagttacttctagaaaatctactcaatcagaaggcagtccaaaaggtccacatcatagtcagctctgggctggattgattattgttgcaataattatcattgcattaattccgattgtttcttcaagattacacgctaactctaataacttagctgaaaagagcgttaaggtttcaaaaagctcatcttctaagtctcacaaggctaaaagtaaaaagagtaagcacagctcttctaagaagagtaagtctaaaagtagcagtgtgagaagagaagaagaaagttcttcaagtcaatctcaagacacaacaccagctgtggttagtcagtcagaatctcaaagtagtcaggttagtcaaagtagtagtacgcaatcttatgaatctagtgctagtcaaactactactcaagatcaaagccaacaatcaactcaacactcataccaaaacaatcaaaatacttggcaaaacaatggtggaagcagttcttcagaacatgaagcaccaagatcttacactgtgcaagagggagattctttatcaaagattgcccgtgaaaataacacttcagtgcaccacttagagcaaattaatgatttagagtcagctgatagtattagtattggccaatcaataaaattaagataataaaaaacaataatgtttacaattctaccaagaagtattattatttacttgtaaaaaataaatacaaggatgttgtcttcagggcagggcgaaattcccgaccggcggttagagtccgcgagctacacatgtagttgaacctcaggtaccgatagttatagtctagatggaagaagacagactaaagaattaaacatgatttagatgattaataaggtctgttgctgaagcgacagaccttttgtatgttatggaggaactatcatgcaaagaaaaacaagtttaagtcatgtaagattagcctactggctcgcttgggcaatgattggtgcattagcatttttgattatgaagattgaagtaccaattattcctggttttgattacttaaagatggatttttctgattcattagtagctttaagtgctttggtttttggtcctttaggcgggacaatgattgccctttttaaatcattattgagcctctttatttcgggatttaatccaatttcaatgattggtcagttggctgcatttttagcaagcttagcttatatcttgccattctacttcattagtaaaaagcatgaagataaagtacaataccaaattttgggattagcagtcggaacatttgctttaacagtagtaatgtctttagcaaactacttcgttttaactccaatgtatatttctttaatgggctttaagctcaactcatcgcttttaacttacattgtttcagcgattgtgccatttaacctaattaaaggaataattaacagtattgtcgttctattattggctaagaccttattgccagttttagaaaaatttgtaagacgtaacttttaaagtctaaataataaaaataatttcatttagcaggagtcatttgacttctgttttttgttttatggtagaatttactttgaatgaaaaagaaaggactaaattatttaatgcaagtagctattgatggtcctgcatcagcggggaagagtacagttgctaaaattatcgcacataatttgggctatatttatattgatactggtgcaatgtatcgagcatgtacattaattgcacacgataataacgttgactatggggatgaaaaggcaattttgaacttgatcgaccatagtacaattgattttaagcaagaagatggagaacaaaaggtttatgtaaatggtaaggatgtatcaattgacatcagaacacctgaaattacagagaacgtttctcaagtttctgccttaagatcaattcgtgaaaagatggttgaattgcagcgcgaaatggcgggcaagcacgatgttattatggatggtcgtgatattggaacgacagttttaccagatgcagaggtaaaaattttcttaatcgctagtgttgcatcaagagctaagagacgcttcttagattttcaagaaaagggtattcatcaagacttaaaagatatcgaacatgatattgaagttagagactataaagattcgcatcgtgaaatttctccattgaaaaaagcagatgatgcaattgaattagatactacaaacttaacaattgatgaagttgtagccaaaataaccgagataattcaaaaaaagcaaaaaaattaaacaaaagtgtggaaaaaagatatcaagtactttaaaataaagtatgatattgggaggtaattatgacagataatagtaatcaattcttagatgctctaaaagaaatgcagggagttgaagtcggcaacattgttaacgttgaagttttaagtgttgaagatggacaaatcgctgttggtgttgaaaatgcaggtgttgaaggtgtaatcactaagcgtgaattcactaacgatcgtaatgcagatttgaaccaattggtaaaacctggtgataagtttgaagctttagttcttagaagagctggtggcgacaaggaaaacggtgaattcttcttctcagttactcgtttgaaggaaagagaagcttacaaggaattagaaaaggtcttcgaagaaggcaagactgttgaaggtactgtaactggtgctgttcgtggtggtttattagttgacgttggtacacgtggattcttaccagcttcattaatttctaaccgttacgtttctgacttgaagccttacattggcaagaagatgaacttgaagatcactgaaattgatcctaacaagaacagattaattctttcaagaaaagacttaatcgaacaagaacgtgaagaagctttcgaaaacgttgcttcacaattagttgtaggtgacactgttgaaggtaaagtatcacgtttaactggttttggtgcctttgttgacgttggtggtgtggacggtttagttcacatttcagaaatttcttacaagcatgttgataagccaagcgatgtattgaaggctggtcaagatgttaaggttaaagttatcggtattgatgacgatagacacagaatctccctgtcaattaagcaaactttaccatccccatttgaagaagctactgaaggcttacatgaaggcgacatcattgaaggtgaagttaagactttaacttcattcggtgcattcatcgaagtagctgatggaattcaaggcttagtacacgtttcagaaattgctaacaagcacgttgataagccaagtgatgttttaaaggttggtcaaactgttaaagttaaagttttaagtgttgacccaagtgacagaagaatctcattgtcaatcaagcaagctgatcctaatgctgctaagagtgaaaacaactcacgtccacgtcgtcgtcaagattctgtagctgataagtacatgaatgacaatgacaacggttttgctttaggtgacattattggtgatcaacttaaagataaggattaatcgtcattagtctaaaaaaagctgactccggtcagctttttttatttcattagatagaaaggggtagaaataatatgtcattacccgtagttgcattagttggacgtccaaatgttggtaagtcaactatttttaacagaattattaattctcgtgtagctattgttgaagataaggctggagttactagagatagaatttatgcccgtgctgaatggatgggtcatgaatttatcctaattgatactggtggtattactctagactctggtgaaattgaagaacaaattaaggcacaagctgaaattgccattgatgaagcagatgtaattgtgatgttaggggatgttactcaacatatgactaacatggatgaaacaattgctaaaatgctttatcgaactaagaagccagttattttagccattaataaggctgataatcctgagcaaagaacagatatttatgacttttacagcttaggattaggcgacccaatcccagtttctggtagtcatggaactggaatgggtgatttactagatgctattgttggtgaatttggggacaaggctaaccaacatgaagatggttcaattcgctttagtgtgattggacgtccaaatgtcggtaaatcttcacttgtaaatgctattttaggtgaacaacgtgtaattgtttctaatatcgaaggaacgactagagacgccattgacacgacttttaccaatgatgggcaaaagtatactatcgttgatacagccggcatcagacggcgtggtaaggtttatgagaagaccgaaaagtattctgttttaagagcgatcagtgctattgaagaaagtgatattacacttttagtcttagatgcaagtactggtattcgtgaacaagataagcacgtagcaggatatgctcatgacgcaggccgcggtgtaattattgttgtaaataagtgggatctacctaaaaaagatagtagaagtatgaaggactttgaagatacaatcagaagagagttccaatacttagactatgctccaattattttcgtttctgctaagacgggtcaaagagttccagatatcttgaagcttgttaaagaagttcatgaaaatcaaactcgtcggattcagtctagcgtcttgaatgacttgcttcttgaggcaactagaattacaccaactccacttgttaatggaaagagattgagaatctactacatgacccaagttgctgtaacgccgccaacatttgttgtctttgtaaatgatccagagttgcttcacttctcataccagagatttttaattaatcaattaagacaaaactttgattttgtgggaacaccaattaaaatcttagctagaaaacgtaaataagccttaaatttcaaaaaaatagggatatatctgcgaaaaagcttgcaactaagcgtcttagtgtgctaattttattgcagggaataaatgaataactcatttttcttattttcaaaggtttttgtttaaaaatattatttagttcattttgggaggtgaagtggaatggcaaacaaggcagaattagtttctgaagttgctgctaaaactgacttaaccaagaaagaagttgctgctgcagttgatgcaatctttaactctattcaagaagatcttgctaagggtgaaaaagttcaattgatcggtttcggtacttttgaagtacgtcaccgtgcagctcgtaagggtcgtaacccacaaactggggctgaaatcgaaatcccagcttctaaggttcctgcattcaagccaggtaaggctcttaaggatgctgttaagtaattgttcagttgctagcaaaataaaaacgtgctaagttgtatagcttggcacgttttttgtgtacaattattgtgatagcacaaatgaaaagagtgaaaaaatgacttattctgaacaactattagatgcaattcaaaatcatgatttttctgataatcgaattctcttgaaaaaggcattggataatgatgatccagaaatccttgcttctttagctgaaaacttaactgatcttggttttactgatctttctaaagaagtttatcgttttttgattggacaatttcctaaagaagacttgtttaaggtctatttagctgaaattttgttaaatgatggggatgaagacgatggcttacagctactttatgatgtaaagccagatagtgacgcttatcttgaaagtttgcttgatttagctgattactatcaaagtaatgggctaattgaaacagcccatcaaaagctcttagaagcccataaattagctcctgatgaagatgccattaactttggcttggctgaattagactaccttagtggtgattacagcgaagccttagacttataccgtgaattagctaaaaataataagacttttggtgaagtagttttaagtcaaagaattgcagcttgtcttgcaaaattgggtgagtatgaagaggcagcaaatgaaattaagagtcatgaaaatgatattttaagtattgacgctctttatgaagctggcttaattatgctttcggctaacgataataaggctgcaattaagtatttagaccaggtaattgaaacccaacctgattatgtaaatgcctatccacttcttgcgcaagcttatgccgcagaagacaataatgaggaagtgctgagaactgcgcaaactggtctatcttataatgaattggatgaagttttgtatagtttgggtgccaaagctgctgctaacttgaatcaattagatgaagcagaacgcttgcttaaaaagggacttgaggttgctcctgacaacagtgacttgcgcttgcagttgtctaacttatatcttcaccagcatcaagatgaggctaatattggcttatttaaggatcttgacgatgaagagttagagccacaagctcactggaatttggctgtttcttatcaaagacttgaggattatgataaggctaagagtgagttcttgcttgcctatccagcctttcaaaataatgcaagcttcttaagacagatgattagcttgttctatgagttgcgtgaaattccaacaactaaggaattgattaagaagtatctgcaagttcaaccagatgatcttgatatgcaagacatgttagatgaattgaataatgaaaatgaatagtaaaaaaagctggtttttgtaccagcttttttgtttggttcatattttttattatgtaaaatagtcaaaaaacatagaattaatatatctcaacagacacaattatgatatcttttaaggagagtatgtaataaagattatgtataaaagagagactttaatattttggtaaataaagaattgaaagcacccatcatatatgaaactagctataatgttcaaaccgctagtcagctaaatgataagattaatcaagaatatgcttcagatgaaaaaaagcaagtattattgacagaatttcctactgtatatgtaataaatgatcctatgaataaaaataactcacaatatgcagtatatgttggtgaaacaaatgatattcaaaggcgtacattgcaacacttggattcagatcccgctaaaagagacgatttttttcatttaaagaattcaaaaaatgtaagtatgtttgtaattggacacgaacactttaataaatctatgactcttgatattgaaaatagaatgatgcaatatcttagcagtgtaccggcagtatatcgtctaaataatagacgtcataatgagcaaaatagatattatgattctgatgaatttgatgatttatttaatctcatttggaaaaaattaggaaagaaaaaccaaattttgtttccagctcgtaaaataattgaatcatcagctatttttaaggcatctccgtttaataaactgaccaatgaacaattaaatgcgaaggcaaaaattatagataatataaatgaagaactctttaaacagaaaaatcaaaaattggatgaaggggcgcttattttggtcgaaggtaatgctggatcaggtaaaactgttttgatgagtaatattttttacgatctagtgcatgaagatcagatatcggctaatgagcaaaaaattgatgacaattctcaaagattatctgttgcaatgatagttaatcaagatgaacaactcaaggtatataaagaaatatcgaaaaaactttttgataaggatgatcaagtacaagttgcaaagcctgctacttttataaagcaagttgatcctgagaataagatagacatcgccttgattgatgaagcacatttattacttacacagaaaaaccaagcctatgccaaatatggcaataatatgttaaaagatattatgaaacgtgccaaagtaattatggcagtatatgatccgggacaggttttatctacggcttcagtttgggaaaagaaagactttgctgaattagaagaaaaagcaggaaaaaataatattatctatttgagcaatcagatgagaattgatgcatcccaggcgacaatagattggattcgaaatgtaatagataatggtgtgattaataaagtacctcaagatgataattaccaaataaaggtttttaaagatccatctgaaatgcaaaaagctattcaagaaaagaatagtgatcaaaaaaatggaataagtagaatggttgctacatttgactgggactattctggcggaaagacacagccacctgataatcaaagatactgggaagtctctgaagggaaatggcatatgccatggaattatgaaataaatagaagagacaagtatgaaagtaagcatagagcgcataaatctgtaaagtatagtgagcagtcatgggctgaaaaagattacacaatagatgagatcggatctacttatacggtgcaaggatttgatcttaattatgtgggtgtggaattaggtccatctgtaaaatatcgaaatggacatattattcatgatccactagagagttccaatagtaaagctactcagaaacgtgattctactaaaagttatgcagacactctgctaaaaaatgaatttaatgtgttaatgacgcgtggagttcatggactatacattcatgcagttgatccagagttacaaaaagcattagaagaggctagtaagtaaaaaatgaaatggagtatttatggataaagagtttgaaaacctagtttcaaccaaaataaattcatctgcagaatataataattttattgatgtactcgcttcgaccaaagaagataatgcacttgtgtgttttcttggagctggaacatctatttctcagggatataaagattggaatgggtatgttcaagatcttatccagtattggaagacccatttacaagatttattaggacaaaattcattttattcatcagtacaggcaactgatattagctttttagactggctaaatgatagaagtggctattctaataaaagaaaagttgatatggttcatcatatgatcaaaaagtattgtaagagtaaatccatggctcagaatgatgaagagaaaactaaatatttagaacatgtaaacgattttgaaaaatattattttcttgaaataaatccaataaaaaagatcaatgagataattgatcaagttcttaatttgagtgcgatttttattactacgaattatgataatcaaatagaaaaagcatatgaagcgacatttcaatcacgtccaaatattctaaaagacatcaatgctttggaaaatattgacaaattagctgataaatctattttacatatgcatggaacacctgttactcctggagttttattagttagttcatctgattcatataatcaattatatttgaataataataatgctaagaaaaaaatagaaacgcaattgataaaacaaaatgcacatgtgctattatttattggttcaagtcttcaagaagaagaggttttaaatctcttttcatcagatagtttaaatttaaaaaagtatgcgttgatgcaacttagggatgatatttctgaagatcaggctaatttagtgaaagagtactatagagaagagaaaaatatagaaattatatggtatgggcataactattctgatttaccaattttcttgcaaaaaatgaataaagatattagcgataagtatcaggaaaagcatgcatttgtttctgccaaggagcttattgacgacatagataaaataatttggatcaattaaataaagacataactagagctttgttcaatgaggaaacttttatagatgattgctttagaaataggttaaataaagatagtattaatttgctcgtcaataatagtaaatttgtaaacgaattaaataagggaaagtattatcacaatttttggagtgaagtaaatagaaaattttcaaaactaaacgagaaaactagattcaaaataataaaaattatagaaaaatcatctgaattttttggtgatgaaaatacaatgaatattttgtataaatatcgtaatgattttgattatttatatgaaaatggtaagaaatttttaaatcgagtatattatccaatcaatatctcaagtaatgaagctcgagtaatttggttattggtcaacttagaagagaatagtattttttatacttttgataatttagttgaatatgaattaaatgagaatatactttttaacttttcttctgcagctttgaaaaagttaatagaaattttgaacaagaaaaaaatgttattacagacatcaattgaacagattttagagaacgaaccaattaaagtactcgagtatttgtttatgaaaaatcggattgtgtataaatctggtgcctttccaaagtatttctatagagatagtaaattgattcaaaggttattgataaatcttagtttaagcgataattttccaaaagtatttgattttgaccaattattaaataatatagattttaatgataaattaatgggcaaggaaatgaacaaatttgttcaaaagtttgcaaaagataggaacataaaatcgaattattatattgatggttggtatacttttgatatgactttaacgccagatagaccgttttttgaagtgcaacaacctactgatcaaagagatgtaaaaaagattattaaaaatttgaaagaggcattaaatttaaaatctaaacaagatgataaaaatataattgggcaaaaagaacaattactcaaagttttaaaaaatagtgagagttggaaaaattttagtcacattaataactattttttagaagaagcaatcagtgatgatacgatattaagaaactatttgaatgagataaataaaatcctgattgctggtgcagagactaataagttagaatttgacatagttaaacaatattttaaccgctttaatttttgtttagaatcagtgttatctggtaataattttgaatttttaaaatatatatctataaatggcactcttaaacaaaagaaaatattatacgattacttattcaatgattttaaacttaaaaattctgatttttactataataaggaaaataaaactaaatggatatctttagaagactttgtaaatactgtagcatatcaatacgtatcattagttgatgatatgataaaaaatgataggggttactttgaaaaaaattataaaagtaaatttaaagatactattttaaggttatctaagcatgaacgagaatatatgaaaggtcgtttttatattttctttgaaaaagataatcctattacagaagatgaatttattggcttttctcatagttatcgaattaatgaaaatatagcaaatagggctacaaacgcagtaactcgactgcttaacacagaattttcagatgagttttgtaaacaaaacatcattttaacactaatatattgtataaagcccatgcaagctaacataaagaaaccaattaaagctgaatcatataagaatcttttatttagttctatgattaattattttttaaaacaagaacaggaattggaagaaaaaaataatgtattagattggattaggtggtatttaagaaatatacctgatgcattaaaaattgtattaaatgcaatctctagaaatataaataatacttctgcttgtgagctcatctttaaagaaatactgcaaaatagaaaatatattaataaaaaatatgagatgtcgtatatctattttagagaagataggagttattcaaaagacagtctaagattaatggctaaagtaattgaaggtctttttataaatgggttattagtcattagtcattctttgacttttaattgttccgaagtagttaaaaaaatggctgaaaataattaccaagacttaatcaaagattttttagaggtgactaagcaatttctcttgccagaagatcaaaaggaattagaagtaaaatatttacgaaattaataaaaggcaataataatcaacaacttttgatgatatgaatatggtattaaatagtcagatcattgataagttgttttaggctaaagtactttgaatgataaagctaatgaatttgaaaaaatagtaatatttgtaaattagtgaaaaaagtagaattgcagcagataagattgtggagaaattataattttcggttgaaaacgggcgattagctaatcgcccgttttttgatataattgcagttatataacaaaaaatataagaagtaatttaaatgattgaggatggtaatgaaaaaaatagttagaggagtagccgtaatttcatctttattatgtttgattaattttgcacctagtcaaatagcttttgctgatgaaaatagtgatcagcaaattgaaaagaaagaagtaactacccaaactttatattgggaatgtattaatcaagatactggggagcttttaaaaacaatcaaagttgatactgttaaagttgttaatggtgtgccagagcgacaattttttcatatgggacgattaccagagaaaattggcaatcttgaaatagcaggtaatccatggggcggacgtgatttagaagtcgatcctaataataaaagaggtgctgtttatcttaaggctggatattatgatgcagaagcatatgaagaacgttcaaaaaataattttggatggggtgatccaaaacaacaaggtattattaatacgactttgatggaatataaggcttaccatggaacaagtgatggttatatagctccaggatactatgatgataataacgaatttcatgggatgatgacggtagatgaatggtgtaagaaaaatcatatgcctagagaaagaaaaataaatcctaaaaaccagtcttctgaagacaaggaagatacagaagatcaaagcatagataatgtaagtgatccggaagatcaagaacaagctgtgtctactaatagatcaaaaaaatcaaaggactctaacaagaaaaatactaacgaaagaaaaagatcatctagtcaaaataaagttgaaaatactcatagtagtgttttccatagtagcttgttttacttgggtattgtagtaataggtatagtggttgggatattttttatccctaagaaattttggagaaaaatttttggtggaaagggtcgtcattcaaaataattcttctttaataggtcaaaaaagctgatttttaaagatcagctttttaatttatttcatattttaaattatgttaagcatgctccccagcatttctactgaacttgttgtaaaatatttactcgtgaggaaagatgctacagttaaaattgataacaaggaattattcattgtaataaaaaatgatgtcgaaaaaagaaaaaatatatcacttcagcatggcaattctagccgtgatttcaattatactagtaattttagattatgtttcagtgattaatctaacaaacggcatatggatgtggatcgatgatagtattctgcttatttttgctattgattacttctaccggctgtatagggcagacaacagggggagtttcgtcaagcataatattttcgatcttttatcaattattccagtcaatggattattcgcatttttcagaattgcgcgtattggaagagttgctagaattacaagacttcttagagttctgcgcctagttggtttaaccggcagactccggaaaattctgtatactaacgggctagtttatttgttatatacaagtcttagtttattaatcattggagcgatcacttattcaattactgagcatgtttcattagcgcaggctttttggtgggcgattgcgactgcaaccactgttgggtatggggacatttcaccgcatacttttgttggaaaaatagttgctctagtcttaatgctagtagggatcggcgtgatcggaactttgactagttcaattacgacctactttattagagaagatagtaaaaatgccgataaaaaagatgaccaattagaaaaaattatccaaaagctaaatgatattgaaaagcagaatcaagaactaaaaacagaaatccaagaattaaaacaaaaagcggacgaaaagtaattaatcgcacacaaaacggttgaaaaaacggtcgattagctaatcgaccgttttttgatgatacgaataatttttagatcctatcttctaaagaaaatatgtctcttttttctttcataagtaaaaccttgacctagggcttcatgaacatcgataactgaaacaaaggcattaggatcttcacgcaagattaattctttaacctgactaatttcccgcggtgaaattacacagtaaataatttttttagctgatcgatcaaatccgccttctgcatttatgaaggtatatcctcgatctagctgaacatcaatcattttagcgatctgttcatatttatcagaaataataaacaatccccgtgcagcataggaaccagcttgaatagaatcagtaattctcgctaaaacaaaactagctagcaaagtataaatcatatgcttaatatcaagataactaagagaaatcgttaagacaaatgcatcaagagctagcaaagattttccaactggaatacctaattttaaatctaagattctggcaataatatctgttccacccgtggttccgccgtatttaaatacaataccgattccaacaccagaaaacaaacctgctagtacaccagcaataaaaagatcatggtctaaatttaattggtttataataggaagatgaagccaaaaggataagaagaaggatagacaaagtgtgccccagattgtcaaggcaaggagccgtttgcccataaagcgatatccgattataattagggggatatttagaagtaacgtggataaacctggattgatgtggaaccaataccgaagtaaaagggcaataccactaatcccgccatcggcaagtttgttagggatgctgatggcatctaggctaaaagcatatatgctgcagcctagagtaatgaagaagatttgtttaaagagttgtttattgaataatttagtcatgttacttccttctttctattattaagaagtgtgaaaattaaggggaatagggaatatatgaagattaataatttaccggaagtttttactgccgcgcttccagttttaaaagagattaatgaggcggggtatgaggcctattttgtcggcgggagtgtgcgagacttgcttttaaatcggcacattcatgatgtcgatattgcaactagcgcctatccaatggaaattaagcaaatttttaagaaaacaattgataccggaattaagcatggaaccgtcactgttctttatgagggtgaaagctatgaaattacaactttcagaactgaatcaggctaccaagatttccgtagacccgaccatgtaacttttgtccaaaacctatcagaagatttaaagcggcgtgattttactattaatgccttagcaatggacgtagatggaaatattattgatcattttgacggattaggtgacttagaaaagcatttgatccgtgcagttggaaaagctgagaatcgttttcatgaagatgccttgagaatgatgcgtgcagttcgatttatgagtcaattgcaatttacgcttgaaccagaaacagaacaggcaatcagtgacaatcatgagttactaagtaaaatttctgttgaacgtatcagagatgaattcgtaaaaatggggattgctcctggcagccaaaaggcattccaaatctttttagatactggtttatcagaagaagtacctggttttaggggtaaaaaagagaatttagctctttatcctcaacttaattttagccctactactgaagctaatctatgggctttgatgattattttattaaaattaccaaatgacaagattcctcactttatgcggatgtggaagaattctaacgcaatggagcgtcaagtagctgatattgttgctttctttgacttaattagctcacacgctccaaataattatgatttgtataaagctggtctagaaacaattgtttcaacaattgatttagctcatattttgggccaaccagtcaatgggagtgccttagttgatagttacgaagcattgccaattaagaataatcgtgacctagtgatagatggccactttttattgaaaaatggtattccagctggaccaagagttgggcttttattagaagaaattaaaaaagccgttttagagggagtaattagtaataacgaggcagcgattactgaatttatttctttaaatcattaactaaaaaaagcaggcagtgataatgaaaattcactgtctgcttcttttttaaacataaaacaaaattgaaaaatacatcagaattgaacctaataaaacaaacatatgccaaatcacatgaatgtaaggaacgccgcgcattgaaaataaaatggcaccgacggtataggcaattccgccccagactaagagccaaaatccagttggccccagaactgggtaaagggtactggaagcaataatcacaatccagcccattaacacgtaaaggatagtatctaaaacaacatgttttccctgattaaagatgtaaaataaaatgccaaaaatggccagggctaaaatgataccaaacattacccatccctttacgccgccaattgcgactaaggtataaggcgtgtaggttccagtaattaaaataaaaattgaagagtgatcgaatatttgaaatactcgcctagctcgggtaaaaatcaaactatgatagagtgttgaaaaaagataaaggataaccaaactagaaccataaagagtaaaagctgtcaccctcagggcacttcctgtatgggcagctttcacaattaaaactaccaatcctgcaacagctagcccaaagccaattccatgagtgatggcactaaaaatattgtttagaatgttataggttttagatcgattctttggttcttgccacaattgtttaaaagacattcatttattccgccttatataataactttataatctatttaataaattttaactcatttttgtatttttgatatacttgagattgtacttaataaattctaacatagaataataattatagaagaataggggatagcacttagaatggctaagattaaagtagtaactgattcctcagttcaattaactcctgaagaaattgataaatacgatattacagtcgttccattaactattactatcgatggtaagacttacacagatggcattgatatcagtcgagaagaatttgtgaagaagatggatgagtctgaagaattaccgaagacaagtcaaccatcaattggaattttcgaaaaagtatttacagaattaactgccgatggaagccaagcagtaggaatttttcttgctcgttctttaagcggaacaattgaagctgctagacaggctgctgacataattggaaagactaaagaagtaactttaattgattctgaactaactgatcgtgcagaagcttatcaagtgctggccgctgctaaggatgcgcaagcaggcaagagtcttgaagaaattgtaaatcatgttgaagaccttaaaaagaagcaaaaattacagatgatggtagttaacctaaataacttgattaaaggtggacgtcttggcccattagctggtaaaattgctactttactaaacattagaattgaattgcatatgccaggtggaaatttagacgttgctaaaaaaggtcggggaaagaagttttctaagaactttgataaacgtgttttaaaggacattgaagaacataagcacgatatcaaagaagtagcaatttcttatgtcgatacgcctgaagatatggaagtttggactaataaaattaaagaaattaatcctgatattaaagtgttaactcgtgttactagtccaattattgcaactcatgctggtagtggtgcctatgcagtattctatacaacggaggacttttaatggcttatcgtgagagcttttatcgttttttaatgactcaaagaaatcctgattctttagatgatattgctgaatttgctaataacgcacaacatgacagctcttttccaaaacaagaggaagactatgaaaaattgtcagaatatttagaattaaatgctggttatttaccaagcatgagcgtttttgacaaggcatatcaattatatttagataatatgaactgaggctaatatggcagaagtagaaccaaataattctcatcaaaataaagaaatttcaaataataaaaagaagcatcttcccaaatatgctcaatttttgttaactggtatagctggtgcggcaattggtgcaggtttgacctttggaattatggaagttaaggaactaaagtcacctttttatcaagttgaaaaagtgtatgagcaattacaaggttcatattataaaaaagtctcaccgcaaacattgcgccagggggcaattaacgggatgcttaatagtcttaacgatcctttttctgagggattaagtggagcaaaccaagaacaagttaataatattttagagggttcgagttttggcggagtaggtattcagatggcagtacgcaacaataaagttgttgtggactctattgttgctgactctccagcttcaaaaagtactattaaacctggcgatgagattgttgccgttaataataaaaaagtaagtgcagctcagtttagtaaagtagctcctttagtcagaggaaaaattggtacaaaagtcaccttgaaacttagacgtgctaactctacttttaacgttaccttaaagcgggctaaaatctcccaatctagcttaactaagcgaactgaaggtaatgcaacaattattacaattacacaatttgacgttaatacggctaaagatttaaagagtgctttaaagtcaattgatactaaaaaatatcctaagttaattattgacttgcaagataatcctggtggtgcaatggatgctgctttgaagtctgcatcgtatttcttgccaaataataaaattattatgcaatatcaggatcgcaagcaaaaagaagttattcgctctgataaaaagctttctggtggcttccatacaaacctaaagccaattattttgattaatgctaatacagccagtgccagtgaaatctttaccgcagctcttgttcaaaatcaccgggcagtttctgttggtcaaacgagctatggtaagggaacagtgcaagaagtagggcagacgcaagattcagaatataaatatacaattgctaagtggcttacacccgatggaacttggattaaccaaaaagggttaaagccaacttatcctgttcctgaatcttctttagctaaactacctcaattccaaagcatgagtattctgaagaaatcaatgactggtgttgatgtggcaactctgcagcaatatttgactgccttaggctatatgccaaagcatgttacaggagtttttaatgatgaaactaagaatgcagttattgagtttcaaaaagcccatggcttgacagcagatggtatagtaaatgggcaagtacaagcgcaactttatttagcggttgcacaaaaactgcaagatgataatcccgctttaaagaaggcaatgagtttaaatctaaaggaaatggaggattaaaaatggcaactattcaatggtatccaggacatatgaataaggctaaaaatcagctagaagataatctagacttgattgatgtcttaattgaagttttagatgcgcgtttaccagtttcttctcgtaatccaatgattggacaattaacaaagaagaaaccgcatattattgttttaaataaggctgatttggctgatccaattcaaactaaaaaatggactcattattatcaagatgagggtaacttcgtgatttcgatggatgcccagcatactacaaacatgactagtctatttaaaattatcaagttggctggtaaggaaaagacagataaattaattgcaaaaggtgcatcaaatccaatgattcgagtagctattgcaggaattccaaactgtggtaaatctactattattaatcgtatggttggaagaaatgctgcaattgttggtgataagcctggtgtaacacgtggacaaagttggttaaagacaaagactaatgttcagattttagatacaccagggattttgtggcctaagttttctgatcaagaagtaggttacaaattagcagcttgcggggcaattaaggcggatatttttcatcccgatgatgttgccttatttgtgattgaatttttgaagcaaaattatcgcgatgatcttgttaaatttgcacgaatttcaagtgaagagatggacagtatgtctaatccagatttattgttagcaatgaccaataaatacggtatgcgagatgactatgataagttttcactctttatgcttcaacgtttacgcaagggaaaattgggaaggattacgttcgatcttagatgacgattactgagataaagaacttacttcaaggagaagtaagcaaagagcaattagaagaattaaaagctgatgaacgaaagggcgtccaaaagctcttaattagctatgaaaaaagacaagctaaatatgctaaagcattagctcaatttcaatctcgtttttcttatgaaaaagaattttggcaaaaagatcaacttgttgctggggttgatgaagtagggcgtggaccgcttgctgggcctgtagttacagctgcagttattttgccacatgattttgatttaattgatgttaatgactcaaaaaaattatcacctaagaagcggcaggcgctttttccaaagattctagaaaaagctgtcagtgttagtgtcggcttagctaataatgatgtaattgatcagattaatatttatgaagcggatcgtttagcgatggctcatgctgttcaaggtctaaaagtaaagccggatgccttattagttgatgcgatgaatgtacctttaaacattcctcaagttaaattaattcatggggatgctaagtctaactcaattgctgccgctagtattgtagctaaggtgtttcgggataacttaatggatgcttatggtgagctctatccagaatatgattttaaacataatgcaggctacggaacccgtgagcacatggaggctctagaaaaatacggtccaaccccgattcatcggagatcttttgctccagttagtgaatacgaaaaataattaaaaaataaaccttcacttttgcgtacatgatagtggaggttttatttatatgaatttgaaagaattttgtttaaggttaaaattacagcaaggtcttggcattactactataggaaaaattgtagcgaattttactgctggtgaagaagtaacagttgacaaaatagagagtttatcattaaaatcaaatatccaaaatcttgttttagctgcaatgaaaaatgataagtttaattcttggattgaaagaattgaattacagtgtgatgttatcactatttttgatacaatctatccaaatgcactccgtgaaatgtataatgcaccaacacttctttttactagaggagatttatccttgcttaaaaaggagattacagttatagttggcgcaagacagccgacaaattatagtcgttttgtcttaaaacaattaattccgcagctgctacagcaagattttgttattgctagtggcttagcacgcggagtggatggaattgctcatcaagaaacattaaaaaatcacggtaagacaattgccgtcattggaaatggactcaaccatttttatccgcaagaaaacaaaatgctccaggaagaaattatggcgaagggactattgatcagtgaatatttaccggatactccgccaagaccttatagatttcctgagcgcaatagaatacttgcgggcttaagcaaaaatattattgtgactgaagctagaaaaagatcgggcgccttaattactgcaaatattgctttagaagaaaatcgcaatatttttgcagttccgggaccagtctcaagtcccttgtcagaaggccctaatgagttaattgccgctggtgcttatccattggttaatgctgattttaaaaatttgctttagttgacaagagtaaaatttttggtattttagaatttggtagaaattgtgcaaggaaggggcattctatgcctactaaacgaaaaaataaaaagaatttagttattgtcgagtctcctcataaggctaagacaattgaaaaatatttaggaagaaattatcatgttatcgcttcaaaaggccatattcgtgatttacccaagtctcaaatgggagtggatgtagaacatgactatgaaccaaaatatatctccattcgtggaaaaggcgatacgattaaagaattaaagagcgaagctaaaaaagcaaaatatgtttatcttgcttccgacccggatcgagaaggagaagcgattgcttggcacgttgctcatgcattaaatctagatccaaaagaacataaccgcgttgcttttaacgaaattactaaagatgctgttaagaatgcctttaagaatccaagaactattgatatggatattgttgatgctcaacaggcgcgtcgtgtcctagaccgtttggttggttattcaattagtccgattttgtggcaaaaggtaaagaaaggtttgtcagctggacgtgttcaatcgattgccttgaagttagtaattgatcgtgaaaatgaaatcaagaactttaagccagaagagtactggactattgatgctgattttgaaaagggctcagaaaagtttaagggtgctttttatggcattaaaggcaaaaagcaagagttgccaaataacgaagcagttcaagatgttttaaagcgaattgataagcggaaaaactttgaaattacaaaagtagttaaaaaggaaagaagacgtcaacctgctgctccttttactacttcaactatgcaacaagaagcaaacaagcgcttaggctacagaactcgtcgaacaatgagaattgcccaatctctttatgaaggtgtgaaccttggtaagggatctgtcggcttgattacttatatgcgtactgactcaaagcgtattgctaatgtagcaaagcatgaagcttcaaaatttattcatgaagaatacggtgaaaattacgcagcagttaagccgcaacattttaaaaatgatgcggatgctcaagatgcccacgaagcaattcgtcctacttcagcttttagaactccagcttctgtgaaagagtatttaacaactgaagaatatcgactatatactttaatttggtcaagatttattgctagtcaaatgactccagctgtttacgatacagttagagctgatattgagcaaaatgatgtaacctttagaacaactggctcaaaacttaaatttgctggatttacgaaggtatacgataaccaaaaagaaaagagtaatgaacttcctgagttgaacgagggcgacaaggttaaacttaagaagactgatgatcgtcaacactttactcaaccacctgcacgttatacagaagctagtttagttcgtactcttgaagaaaatggtgttggtcgtccatcaacttatgcaccaacaattgataccattcaaaagcgttactacgtaaaacttgaaggtagatcaattgtacctacagaattaggtgaaatcgtagataagttaatcgaagagtttttccctgacattgttaatgtcgactttacagctcaacttgaaaatgacctagacggggttgaagtagggaagaagaactggattaaagtagttgatgaatactacaagccattttctaaagaattagataaagccgatcaacaaattgaaaaggttcaaattaaagatgaacctgcaggctttaactgtgatatttgtggagctccaatggttatcaaaatgggacgctatggtaagttctatgcttgctcacgcttcccagattgtcgtaatactaaaccaatcgttaagaagattggcgtaacttgtcctaagtgtggtaagggcgaagttattgaaaagaaatcaaaacgcaaccgtaaattctatggctgttcacgctatccagattgtgattttgtttcatgggatcaaccaattggtcgtaattgtccaaatgatggtcacttcttagttcaaaagaagaacaagaaaggactagtaatcctttgtccaaatggtgattaccgtgaagaaccagaagaaaattaaattataataaaaatcaatgatatcattaaaacgaaagcggtttaatgatatcatttttatatagacttgaaagagtcgagcagaaaggaaagattgcatggtaaagaatgtaaccgtaattggcggaggtcttgcagggagtgaagctgcatggcaattagctaagcgtggcattgaagtagatttatatgaaatgcgacctaagaaaaatacgcctgctcatgaaactgcaaactttgcagaattagtatgtactaactcaatgagatctaaccaactgtcaaatgctgttggtttattaaaagaagaaatgcggcagctggattccttaattatgaaagcagctgatgaaactgcagtacctgctggtggagccttggctgttgacagagataagtttagtgcagttgtaactaaaactttgaaggacttgccaaatgttcatgttcatgaggaagaaatcactgagattccaaaagatggtatcacgatcattgcgactggtccattaacctcagatacactcgcagaacaaattaaggagttttgtggtactgactcacttcatttctttgatgcggctgctccaattgtggcagctagttccattaatcgtgatattgtttataaaaaatcacgttatgacaagggtgaagctgcatatttgaattgtccaatgactaaagaagagttttacaatttctacaaaaacttagttggggccgagacagctaccttacatggctttgaagataagaatgtttttgaaggatgtatgccaattgaagtaatggccaaaagaggagaaaagacaatgctctttggcccacttaagccagttggtttagaagatcctaagaccggaaaaactccttatgcagttgtgcaattgcgtcaagataatgcagctagcacaatgtataacatcgttggtttccaaactcatttaaaatatggtgagcaaaagagagtcttttcaatgattccaggtcttgaaaatgcaaaatttgttcgctatggtaaaatgcaccgcaatacctatattgctagtcctgaagttttgaatgcaaattatgaagctagaaagcaaactggtctcttctttgctggacaaatgactggagtagaaggttatgttgaaagtgcaggttctggtttagttgccggaattaatgcggctagagaagctttaggagaagaaacactattctttcctaagtcaactgctttgggttctatggccaactacatcacaaccactagcgcaaagcatttccaaccaatgaatgcttcatatgctctcttgccaaaattagattacaaggtaagaaacaagcaagaaagacacttagaaatttcaaagcgagcattgaaagatcttgaagcctttaaggaagagaagaagcttgattaataatgtctaaagaaaatgataaattaatcaaacaatttcaagattacttgaactatgaacgtaattatagtaaaaatactgtaaactcttacttaaacgacctaaatgaagctaaggaattttttaaagaaaatggaggatttagcggctgggatcaagtcaaaagtcgcgatgttgaaattttcttacaaaacttagcgactcaaaataggtcaagaactactcaagcgcgtaaaatgtctagtttaagatctttttatcgctttcttgttaagcgggaagtgctagataatgatccaatgcagacaattagtttaagattaggcgaaaagaaattaccacaatttttctatgaaaaagaaatgcggcaagtctttgacagtcttgctggtcatgaaaagttggtagtaagaaatcgtgcgatgtttgaacttttttatgcgactgggatgcgtttaagtgagatggcatctttaaagctagatcagattgattttgatttaaagattatcttagttcatgggaagggtaataaagaccgctatgttccttttggaaaagatgcggccaatgctttaaaagaatattgtgatgaaggtcgaccagctctactaggtaaaaatgaagatcgaggctatgtatttttaaataaccggggacaaaagttaacaggccgcggaattgaatacattatgcagcaagtttttattaaagctggagttggtggaaaggttcacccccatatgcttagacactcttttgcaactgaaatgcttaataatggagcagacctaaggagtgtgcaagagcttttaggccatgaatctttgtcaacgacgcaaatctatacccatgtcacaatgaagcatttacaagcagattatcaaaaatttttcccaagaaaagataagaaagacgaggcataataatatgacaacaatttgttctgttagatataacaataaaacagccatcgctggagatggtcaagttaccttaggtgaaaaagttattgctaaggcaactgctaaaaagattagaagaatttatcatgatcaagtagtaatcggctttgctggcggtgttgcagatgcagttagcttgcaagatatgcttgaaggaaagcttgaaacttattcaggtgacttacgtagagctgccgttgaaatggctcaaagctggcgtaaagatccaactttagctaaattacaagctatggtaattgcttttaatgataaagacttattattaatttctggtaatggtgaagtacttgaaccagatgaagacgtggtggctattggttctggtggtaactttgcccaagcagctgcaattgctatgactcgccacagtaatgggatgagcgcaagtgaaattgctaaagaagctgttaagattgcttccggaattgatgtgtttacagatgaccacattactactgatgaaatctaggtgaaatattttgactgaagaaaaaactccaaaacaaattgtagaattacttgataaatatattattggccaaaacgaagctaaaaagtctgttgctgttgcattgtataaccgttatcgtagattgcaactaccaaaacaaatgcaacaagatattacgccaaaaaacatgttaatggcaggtcctaccggtgtaggtaagacagaaattgcacgtcgacttgctaaaattgttgatgcaccttttgtaaaggttgaagcaactaagtttactgaggttggttatgttggacgtgatgttgaatcaatggtccgtgacttagttgaagaagcagttcgaatggaagaaaaagatcaatttgaacatgttaaaatgcaagctactaagaaagctaataatcgtctagttaagttaattgtgcccggaattaaacgtgaaaaccgtgaaaattctatgcaacaaatgatgcagatgctttctggtaacttcaacatgaatcaacctcaagataatgaagaagtaactgatgctattcgtaatgaacgtcttagcgtagctgatcaacttaataagggattacttgagaatcgtgaagttaccatcgaagtagaacaagctccaaaggtaaacccaatgggcgatatgatgggccaaatgggaattgacatgtcaagtttgatgggcgacttaatgcctaagaagactgttaagcgtacgctaaaagtatcagatgcacgtgaagttttaattcaagaagaatcaaagaagttaattaactacgattctctctaccaacgtgcaattgagcgtactcaacaaaatggtattatctttatcgacgaaattgataagatcactgctggtaacaagaagacctctggtgaagtttctcgtgaaggtgtacaaagagatatcttaccaattgttgaaggttcaactgtttcaactaagtatggtccggtatctactgaccacatcctatttattgctgctggtgcttttgccgaaagtaagccaagcgatttaattccagaattgcaaggacgttttccaattcgtgttgaattaaatgccttgacccaagaagacttcgttaagatcttaaaggatccacaaaactcacttttgaagcaatatattgcacttcttaaggctgatggtattaaattagtctttactcaagaagcaattgaccgaattgctcaaatagcttttgaagtaaatcaaggaactgacaacattggtgcccgtcgtttggcaactattttagaaaaattacttgaagatgttctttacgaaggaccagacatgaacatgggtgagatcactattactcagaagtatgttgatcaaaaattgagtgatataattattaataaagacttaacaaaatttattttgtaattttagtagataaagagaagttaaattatggattatcaattaaagaataattttttaacagtaacactttctgataagggtgctgaaattcaaagtgttaaagatgtaaatagcggtcgagaatatatgtggcaagcagatcccgaaatttgggaacgtcacgctccggttttgttcccagtagttggacgtttaaaggacgatcaatatacttatgatggtaaaacttaccatatgggacaacatggttttgctcgggatgcgcaatttactgttgaagaacaagatgataagcacattgttttccttctaacgtctaatgaagatactaaaaaaatgtatccatttgattttgaactaagagtatcttacagtttaatgaataatttgctggaagaacactttacagtaactaatactgatactaaagaaatgatctttggtattggtggccaccctggttttaatttgccaactgataatggtttgaataagaatgattactactttaagttcgatccttcaatggaccatgtgaagattcctttaaaggcaccatatcttgactgggaaaatcgttctttgctcgcaactgattcaatgtttgaaattagtgatgaattatttaaggatgacgcctgggtctttgaattaaagcaacctaacaagatttctattagaactgataagagtgattaccacattaacgtcaaaatggaaaatgcaccatttgtgggtttatggtcacaatatcctaaggctggcaactatatttgtattgaaccatggtggggaattgcagatactttagacagtgatggtcaactagaacataaacgtggaatgaatcatattgctccaaatgaagtttgggagaatggttttactattgcgtttcatgacaaagctaagtaattaagacaaataagactttggttgaaagatcaaagtcttattttgtatgcaggtgagaaaatgaagattggatatttaaaaaatttaggcagacatgagctggaaaaagcagtaagaagatggcaaactttacataaagatgaaaaggtgaatttagagcctgtttcatatgatgagattgaagataagattcaaaacaatgagttagatgcagtcttagttaattcaagacatactatctatcagcaactagctacttatccggttgatgaggttgctgtagtggccctggtgcaagcgggtaattttaataaatatcaacaaactgttgaaatgagtgatttaaggaatttaccttgcattatggtagcgaaagtagaggaagaaaagagcgaataccactatttaaaaggtgttcttcaagttaatagtgatttacttgcggttgaaaccttaggagaagctgttttaatggttgaatctggatctggctatttaattatgaatgaaaaaacagcagcccacattgatgatgaccaagtacaaaagttattcttgttacgagctggaaaacaactagctgaagaatatgcttttattgctaaaccagaagatcagcgagtagaaaaattgagcaagatattaaaagaaattatcaattaaaagtaaaataattatgtaaagctataaaatgatattacttaaaaactctagtgcaaaactagagtttttttataccttggcgtatacaagttcccattctggtaggaattttgttaaaatagaatatatgttctagagagggtgaaaagaagtgctgactaggtcacatagaatttgcagtattgcaatcgtggaactaagcttattattaactaatcgtctattgatcgatccagttaacaacattattattctggctgcgactgccattggcgcttctttacctgatattgatgaatataacagttctgcaagcaagaagtcagtgatcaattttagcctttttcttaaacatcgaggaattacgcattctttccttggctgggctattttttctggcggtctatattatctaatgaataaatttattcctattcatattaataacttaacttctcagaattattggagtgcactttggtttgggctggtaattggatattttttgcatttagttgaagatagtttcagtaagcaaggagtagagtggctagcgccattttataagaaaaaaagaaagtcaccaattcattataaagttggaggttgctttgagaactttttaactatgatgtcttatttagcggtaattatgatgaccttttattggatttggctttctttgacacctgcaacccaagtctttttgttttgaaaagtggatttaagcctgtaagataggtgctgggggaagattccaagagaggagtcctgaatatgtcccaattattagtaatagccggtttaatcggtattttgtatggtgcagttgagcttaaagcccagccaattccagttgaaaatgacacagttcataaaggacgttagttgacctagatgaccaagagctaaaattgctcttggtcatttttattttaaccagtatactggtagaaagaagaatattaaaggatatgaagtatggattcgaatgaattaatttttactaaattggaaaataaacgtttacgttataatttgcttgcagatattttgttaattcttggaggtattttaatgtttagacagcctccaatgagcttattatttcaattacttggagccggtttaattattatcggaaccgtatttacttttttatcatttcgagtaaggactagtaagcaatatcatgacctatctttattagttaaaaatgagccaagtagttttaaggaggtcgttaatttatttggagcaaagttaacggcattagctttgttggtgggaataggtctgatagcattagcaatttgctttttctttttacttagtcgctcttggattaaagctttattgtttttcttaacatttgagactgtaattgatttgaaagattttatgaataatatcacaaaattaaaggatgaaagtgcaatttaggctttcatcctttttatatcaataaaaagatttgtgattttatgagcatattattttactttgattagtggattagatattatagtactataagaattttactttcgagaaagaatcactttaaaacactatataattgcttattctgtaaattttcctgggtgagaataagtaattaaactggaggttatttttattgataagtattgttaagagtaaatcatttggtcttgcagctgtaatgactttaatttgttccgtggcaggtatttttctagcaaaattaccctatgttaacttgattggtgcgttggtaattgcacttttattgggaatttcactgcaggttttaccagttggggtaagagaagaagcagcaccagggattggttttatttctaataagtttttgagattaggaattattttactgggttttagacttaatcttactaagttagctgatgctggtattaaaacaattttagttgcaatgctaggagtaagtggaacgattgttttgacttactggcttagtaaaaaatttggggcagaagatgaattagcagtgttatcagcttgtggctgcggaatttgtggagcagctgctgtaatgggcgtttcccctcaaattgaaagtagagatgaagaacgtaaaagagaaaacgaggtactggctgttgctgtagtttgtgtgatgggaacagtatttactctcttagaaattgtaattaaaccaatgcttgggttaacagattcacaatttggtattgttgccggtggatctcttcatgaaattgcccatgctattgcagctggtagtgcttttggtgaagcaagtttagatagtgcattaattatgaaattatcacgtgttttacttttagcaccagttgctttaataattggatactggtaccaaagaagactggtaaaagaaagtgcgcaagatcatacacaagcacctaagaaattaccaattccttggttcttaggcggatttattttaaccagtattttaggtactttcttaccattccccccagtagttttagatggcttagttcaagcagcgtatgtatttttggggatggcaatggccgctttaggtatttccgttaacttcagtgttattttcaaacgtggtggtaccgtctttggggctgctgcaattagttctacttgcttgatgatcttcatgattatcatgagtaagttattcttttaaataatgataaaaagccgattgcttagtgaagaagcaatcggcttttttacatttgatcatatttactccattgatcctgcaatttttcaattaaaggcataaggcgagtttggttttgctttaagtaacaggcatagaacttttgatgagctacttcatctgataagggacgaactgaacggttattaggaagattattaccccactgtgagtctaaactagttaagttagtagtaaagaagggaagaacggaatactgtaagatttcgctataatctgttgactcatcttggaagattattttgctatctggtatttcatcatgataaatctgggtccaaaagccgatgttagcaggacttaaaattgtttttccttttaacattttaaatgataattctggattttcattaaacttacattcagtaggtaagttaactgacattgattctgtacctaaataagtagaggtaatatcacgattttcaatcggaaaattaagtagtaagcaagtgaattggtgttcagcaagtaaactttcaaaattactttcaattaacttattttcgagttgaacattttgatcattcaaagagcgtagtacgatcattggaccaggcgcattaaccccaagaatgagagtggtttgatccttttcaaattgcttaacttttttactaaaatctagattatcattaagcagttttttagcttctcgagcagtgtattttccagtttcgcttaaatatagtttattaggtttacgaataaaaagtttaacgccaagttgctcctctaattttttcatcgaatgagtaactgcaggttgagttaacccaaggacttcggcggttttcgcaacagttccgtatttggcaaaagttactagttcttctaataagtagttttcaatcatttttcaacctcgttgctataaatctaatttatcctagcatgaaaaattatcaattttcaagcaaaaatatggtccgtataatcgttgatgaaaacttaaagaaaaaagaaagaagaaaactttatggcaaagatagtgattttaactggaagcccacattttaacggtgcttctcaaaaattagccgatagttttgaaaaaggaatagaagaagctgaaaatgaagtttatcgatatgatgctggtcttcaaggtgaaagtaagccgcactttttacaattagaacatgcgccaggaatggaaattggtattccagataatgatgtagtggaaaaagaagttattcccaaattattagctgctgacgtagttgtgttagtttcttcactttattattttggtattaatgcccaattaaaagcagtcatagatcgattttatgattataatcatgaacttaaagataaaaaatgatttttatgatggctggctatggaactcgggaagatatggacgccgtgaagttacgtatggaaaagctcagtagttatatggactggaaaatgattgatcaaacttgtgcggatgattcatggaatgagcaaaaattagaaaaatttgctcagaaagcttataacttaggtaaaagtattaaatagaaaattgaggagaaagaataatgaaatatgcagaatttgttaaagctggcgaaatgaaaattattgataagccaatgcctaaaattgaaaaaaatgatgatgtaattattaaggtagttcggacttgcgtttgcggctcagacttatgggcttacaatggtgtagaagaacaaggtcatgaaaatggcggtcatgaagttattggaatcgtccaagagattggtaaggatattactacagttaaaaaaggtaattttgtaattgcaccatttactcatggttgtggccactgccgagcatgcttggctggatttgacggggtatgtatgagccatgatttaagtgaaaatttctctaatggttatcaagcagaatatgtacgtttccagcatgcgcaatggtcattagttaaaattccaggtaaaccagatgactatactgaaggaatgttaaagtcattcttagccttagcagatgtaatggcaactggataccatgcagctcgtgtagctgatgttcaaccaggagattcagtaattgttttaggtgatggagcagtaggcttatccgcaatcattgcagctaaattacgtggtgcaaaacaaattgtttctactagtagacatgcagaccgtgaagctttagcccgtgaatttggtgcaacggagaatgtagctgaacgcgatgaagaaggaattcagaacttacttgcaattactcgcagcggagctgatgcagtattagaatgtgttggaagtaaactatctaacgaggaagctttgcaagttgggcggcctggatctcgcgttggacgtgtaggattacctcatggagctgaattaaatccaggtttaattttttacaaaaatatgagcgtagctggtggaccagcatcagtaactacctatgataagcaagtcttactaacagcagtcttagatggtaggatcaatccgggaaaagtatttacaaaaacatttactctcgatcaaatcaatgaagcttaccaggaaatggctgatcgaaaagcaattaagtcatatattaaagttaatgattaaggagaataaaatggctagctggagcaaagaagaattagtagcttttaaagaggctcaaacattgcaaaatcgtccttattaatgatgatcatgaaaattttgcagaagataaccctgtctgggaagtaatagttgataagcaagtttttattcgcggtgcaaaaggtattgaaaatactaagtggtatcaagccgggattaaaaatggcgggcaagttgaagtggcaggtaagacatttgaagttgaatatcaacctgttaaaaatgcggaattgattaagcaaataacagctgcgtataataaaaaatatcaaggacaatatccaattgacttgatggtgtctgatccagtttctaaagccacggtcgcagttgtaaagaaatagagaattatgaagaagaaaagtctatttattttaattatctcaagtatcttgttgattctaacgggatgctcaagacaaagtaatagtagcaataaaaaaatacagattatctcaacaccaaccttgtttttccatggtggaggttcttcctaccatgcagaagagcatatggtcaatgccgccaagaaagctggcgtaactaagtcggttattcgagcagaggtttcgaaaactggcaaagttactttagttggcacgtggcctaaaaatgctaaaaatccaatctgtgaagtaaactatgaaaataatcgtcaacttgattttaataaacatagtgcttatgcgactaatgtagtaaagacactccaaaagaagtatggaattaagaaaatcaatatggttggtcattcgctaggcaatatttcaatcatttactacatgcttcagaatggaaacaagaagaatatgcctcaaattcaaaagcaagttaatattgctggtcattttgctggcttagattttgatggaattcctaattcaattaaacagccaaaagggatgaagttgaatagtaagggcaagccaaataagatgaattcaacttatgaacaaatgaccaaagttagaagcatttatgctaaaaagcacgtgaaagtgttgaacattattggtgatgttggcaacggtagtgatggtagggtagataacaggtcatccctttcattgcagtatcttgttagtggtggtaacactacttatcgtgttttgaagattaacggcaaaaatgcacagcattcaaagctccatgaaaatgcacaagttgataaagctcttattaagtttttgtggaataagtgagggcacgtttgattgaaggaataaaggactgatttggattaaaatttctagattggtataatattaaacttaattggtatatttatgtaatataaaaaataatactaatatactaaactctatgaagtattgattaatgtttcatagagtttggttatactgtatattacgttttgataaagaatggagggttgaaaatgctgccaaacaagaaaaaacaaataagatctatagttggaatgttggttttactcatatttttaatcctggtgaatgtatatcagcagagattagatgtatattggactagttttttgattatcggcggaagcctattgttgattggagttatttatcagattataaaaattatcaaggaatagttagataatagatgaatttattgaaatataaattaactatttatgattgattttgattagatttcatgatatcttaatcatatcaattgaaattcacctttagaaagaagggtcgctgttgcgtctttaatcttgcaaaactaagcatagttgaaattattcgttttttattaaagggatgaactatgcacttttgacaagattattagacggacatgatcttcttttaatacgtaaaaacatgaagagtctgtacttgtcataagtgcaggctctttttcgaggtgatttgagtgagcagcattaaaatttcgaatgtatcatttaggtatgaagatagcagcaacaatatttttaataatttaaatctagatttagatagctcttggaaattaggattagttggtagaaatggacgagggaaaacaacttttcttaatcttttacagggaaaattagttggaagaggtaaaattcaaacaaaattgaatttttcttattatccaattaggattaaggatccagctaatatcactttatacggattacaagatcaaattatgtttgaacaatggaaactagaacgtgagctgaatttaatgcatgttgactcaagtttaatctggcagccatttaatactctgagcggtggagaacaaactaaaattttattagctttatcatttattgatcaaaattcttttcctctcattgatgaacctacaaatcatttagatgaaaaaagtcgtcaggaaatctgtaaatatttaactaaacatcataaaggatatattgttgtaagtcatgatcgtaattttttaaatcaagtaactgatcatgtgctagcaatcgaaaataccgaaattcatttatatcacggaaattatgcaacatatgaacaaattaaagaagaccgtgatgaattcaatcgtgaaaaaaatgaaaaactagctggcgaaattaaaaacttacataatcaaaaagaacaattttatcattgggcacaaaaaatagaagctagaaaaaatttgggacaaaaaacacaatatattcttaaccgtagagctagagtaaataaggctgcgattggacatgcagcagccaaaatgatgaagaaatctattacacgtagaaatagaatggataaaaagattgaagaaaaagaaggattgatggttaacattgaagatataccaaaattaacgatgaactttcaagctaattatcattccactcttcttgaaactagaggtttaggtctaaaggtaggagataaacatctattttctaatttgaatttgatagtaaaaaatcatggtattgttgcacttgaaggtaaaaatggctctggaaaatccacttttttaaaatttttattgaataaagtctcagcaaatagtaatgggagatgcgtgctagctaatgggttaagaatttcgtatttaccacaagatttcacaatatatcaagggagtttaaagaattttgcgcttcatcaaaaattatcttataaagatcttctgaatattttaaaaaagatgggctttcctcgaactaactttaatgtgccaattgaagagatgagtatgggacaacagaaaagaattgctttagctaaatcactacttgagccagcagatttgtatttatgggatgaaccagcaaactatctagatgtctttaatcaagatcaattgattaatttactacaagaaataaagccagcaatgcttttaattgaccatgaccagtattttattaaacaagttgccgataaaagaattaaattagcaaattaaaccatattaaaaaatggataggggaaaagaaacctatccatttttatttacttatttagttatgtggaaaaaatgattaattaaaattcgaattttcttgtaaaaatagggtgagtacgatgatctaagtaggctgcttcttttggtgtaatttctaaaacccgcagatcttcttttgccccttcaatatcatctgcatatatttcatttaaataatcatttttttcaaaaatctcgtcaatatattcatgttcgacatttttaattattccccggattgaaaatccacatgaatccatcgtgccatctcctttgtacccattaataatcaccttaggttgatggatcaaatcttgaaagaatggattttgactagaggtaacaatgtagagcttaccatttttattcaaaactagatcacagacttgagcagaaggtgcaccatgatgtgtcgtagcaacatcaacattgtgaacttcattagtcgcaaattctaagaattcttcattactagtttgattatttaagatactaaccatgtctattcctcacttaaatttatttttattcaagttctattatagaatggatttgtgatatatctatattagaagtatttgattcgaagttttctataattatatttacttgaaagtatgttggcttgtaagtatacttttaatttgtaagtagatatacaacctatattggaagaaggaagattgctgtggcagaagaaaaatattacggtgcaaatgcaattgttgatagcttaattaatcatgatgttaaatttgtctttggaattccaggtgccaaaattgatcgagtatttgaattacttgaacattctaaagatccacgtacgcctaaatttgttttaacgcggcacgaacaaaatgcggccttcatggcggctggagtaggaaggattacaggaaaacccggtgttgtccttactacttcagggccgggtgcatcaaatttagcaactggcttagtaactgctacagcagaaggtgatcccgtactagctatttccggccaagtgcagcgaacagatcttctgcgtttaactcaccaaagtatgaaaaatgcagctttatttgctccgattactaaatatagtgccgaagttcaagagcctgagaatatttctgaggtgattgctaacgcatatcaagaagcagaggcatctaagcaaggggcaagttttgtttctgttccacaagatgtaactgatgcagaagtaaagacgagcgtgattgcaccacttgagccgccaaagttaggaccagctagtccaattgaatcaactttactttcacagcgtattaaagccgcaaagcttcctgtacttttgttaggaatgcgggcatctgatccagaaactaccagagctatcagacgtttaattgcggaaactcatttacctgtagttgaaacttttcaaggtgctggaattatcccacgtgaattagaggatgatttcttcggtcgtgtaggtttgtttagaaaccaaccgggtgatcaattgcttaaaaagagtgatctggttattgcaattggttatgatccaattgaatatgagcctcgaaactggaattctgatcgaagcgcgaatattgttgtaattgattcgatgcgggcagaaattgataaaaattatcagcctgagcgagaattggttggagatatttctcaaactttagacttcctcttaccctatatgaagggctattccatgccgaatgaatctaaagagtatcttgattcattacgtaaaactttgcaaaaacgtgatacaccacctgctgtgactaaagatcaagtgaaaagtcatcccctaagtattatccaggccctacaagaccgagttaccgatgacatgacggtaacagtggatgttggtagtttttacatctggatggcacggcactttagaagttatgaaccacgtcatttgctttttagtaacggaatgcaaacacttggagttgctcttccttgggcggtcgcagcagctttggtaagaccaaatacaaaaattgtttctgtttctggggatggaggcttcatgttctcctcacaagatttagagactgctgttcgattaggtttgaatattgtccatattatctggaatgatggaaattatgacatggttaaattccaagaagaattaaagtatggcgattcagcagctgttaaatttggccctgtagactttgttaaatatgcagaaagctttggtgctaagggttaccgtgtagagaaagcagctgacttagataggattttggataaggcctttaaggaagatggtccaactgtggttgatataccagttgattacagttttaatcaagaattaggaaagacaatcttagaggatcaactgcattaatggaaggtagaaaaattatggcaaaatatgaaagcaaggtttatcaacatggtactttggggatgctggtgccaggattgtttgaagggacaatgacagttgcagatctgttaaaacacggtgactggggcattggaacagctagcggccttgatggtgaaatgattttacttgatcatgtaccgtatttagctcaaagcaatggtgaaattagaatcttaaaaccagaagaaaaggtcccatttgcgacagttcactttgaagagataaaagatagttttaaggtcgaaaatttaactcaaaaagaattagaagataaaattctagttgattacccttataaaaatgtctttttcgcagttaaaattgtgggaactttttcaactgttaaaacaagagtagttgaaaagcagacaaggccttacaagactttattgcaggtagcagatgaacaagctgtttttgaatctactgatgtttctggtacagtcataggttactttgcaccgaagatgttccaaggaatggcagctgctggataccatttgcattttttagcagataataagtcaattggtgggcacttattagactttaagataaaagaagcaactgtttatttacaaccatttactactattgagcaacatttgccaatggataaccaggaatttttgaacaaagatttggatattgctgatatgcatgatcaaattcaaaaggctgaaggataaaaaagcagatcattaccgctaattatggtagtgatctgcttctttttataatttatgatttaactgctttacttggatttttacttgatggtagatacagagccaaataattaagtatccgatgatatacagtgcagtaaaaactagaaatgggataagttgtaactcaatccaattgttaaaaacataaaagagaaggtagtcaacgtaaattacaattgcatcaatcatagttgcaagtccaagagagattttttcaactttaaagactgcactagtacctcctgcgataaaggctagtaatagactggaaagaatattcttatttacgttttgaatcgaaatagtatggaagttaatggtaaaagaataaatataataaaaaatcacaagaattaaggggccaaatcctgcagctttcaggccacttttaataaaatttttgataaaatctttcattttaattcagttccttcctaattttagaaaagcatcgtcttgaaacataatcgcttaacccatttttcataatgacattcacaccagaagtttttgtttctttaaattgatcgatataggaacgatttataatagtagatttattgatacgccaaaaattagtggggagaatatcttctatttggtagagtctttttctgatgtgatattgcttattgttacagatagcaaaaaccttattttcaataattgtaaacatcataatatcgtctaggttaagcataattaaatctttgtcatcataggcaggtattatatttgaattgccatttgataaaacgaattgctctaattgagtagaaaaatcattttttcgatggacggtagcttcgacaatttcttgactgtttggattaataaataacttaaatttcatttcttactcctttcaagttaaattatatcgatataggagatttttactttgatttatcagtcatcggtcgaaattgacttttaatcggtaataatattttgatttcaaaaatataaaattacgaaagcaagcgttgaccctttttgttatttaaatgaaataatattacgcactaataaaattattaattaaatattatgcaatatgcttattagcacaatactatttataggaagatttaattctaaagaaagtcatataaattatctaagagtatagaataagaaaagattacatgttactatatcacttgtaattaattttagataatagtacattaacagtgatgacgagcatttatgttaagtagtaaaagggatgataaaagtaaggttaaatagatttaaaatttaagctaatttaaataaataacttgtctaattaaacaaacttaaattttgaagttggaggaaaatatggtttcaaaaaacaatattgaaatgaaatataaaaaaatgagagacgaaaaacaacgtttctcaattcgtaaatttagtgtgggagctgcatccgttttaattgggctaagttttagtttatataacggacaacaagcatttgctgatactgttgataatggcaataagtctgttgtagcaaatgcacaagataaagaacaaacagacaataaacaaaatactgatactaatcctcaaaataacgaagataaaacaaataataatcaaactcaaaatacagtaactgctgatcttgatcacagtactgttggggctagttacaaggctgatactactaatgctagcgaagctaacaagagtagtgataagtcagatgaaaagcaagctgcaactactgaaactgctaaaactgaagaagctgctactaaggaagtagaagcaaagaatactgcaaatgatgatgtagctaagaaaactgaagaggcagctgctaagacagatactaaggtcgatgttaataaaacagtagtagaaaatgtaaagactgaagctgctactcctaatgtagagactaggaacattgaaactcaaactgcaaagactgatgaagaaaaagtagaaacagcagttgacaatacttcttctgatttaaaaaacgcagtagagaatgcaaatactgaagtttcaactaatacatttaacgtaaataaagcagttcgaaatgcattattccttagtgcaaataatcttgctgaacgtaaggtagcagctatagcacttccagctgaagcagaagatcctaatgccgtaacagttagtgatgcgaagggatttattgatgcaattcaaaatgggactgctactactattaatgttgcaagtgatcttaatttagcagaccaaacagataagaagtatacagaaattaatatcaagaataagcgtaatattgtaattcaatcagataatccagaagaaaaacgtacaattgatttctctggatattcatttgatatgaatacagagaattccgtaacctttaaagatttgaatatttatgctcgtagttactggggccttgtttataatgctggtggctacacatttaataatgttaactttactggttcacaacttatctatactaaaccaagtattaattcaaccttaacatttaagaataatattactgcaaattctgtttcctcttatgtaggaccacttgatggtaagacccgcgatactcaacaaaacggtgggcagcaaattcttcaatttgaaggtggaacaaatcaaattatttttgatgaaaacagtaatgtgaccttaacaacagaagatgctaatgctcttgaaattgatggtgggaccacaacaattgatgtaaaagacggtgcaaatgtagcaattaatccacattctaagggtaatcctgaaagtcgtaatggaattggaactgggtatgttgctcgtgctattgctgccaatgcaaagatgacaattaatattgatccaaattcaactttaactattaatactgaaaaggtagatgacgataaagatgttgcaggagcattatatttaaattctgatgctgctcttaatgtaaatggtaaattagttatcaattcaaatggcacaccaagtgcaagcaaaagcaatggtgttccagtatacatcaatggaagtgcaaatattaatgttggaaatggtggtagtttcgtattagatgctacaaatcttggagactatagttcaagtctaatttctgttaatggtaaggggacggttaagttagatcctcactctactttcaagattagcggtgacggtactggagctgtaactgcaattaatctttcaagcggtagtactttcacttctgaccaaccagattcatttactattgatctctccgcaaataccagtaatggtaagtcactaattaaaaatggtactattaatttcagtcgtgttaagacggttactgatggaaacgaatcacagcctttgggcaaaattgatgtaacttatgatagaaatggtaatgctacttcttacacaattactgcacaagataaaaatacggttaatcaagtagcagagggactggctaacaagagcttgattagcttagttaaagctggtgaggacgttaccctatctaaccttcatttaagtaagaataatgtattgactggtactgtagcttcaagtggtagtgacaatccaatttatgtaactgttaccgttggtggggtaagcactaatgtgccagtagtaggacattacactgtgtacaccaaaactaataaaacagtaacttcaaacaatgttgattacgctgcacaaactgcttcaactggtggtaatttctctattgatttatcaaaacttgcaagtagcttgactaatgatgcacaagttacagttactgctacaaaagatttcgttgaatccgctcaaactaaaagcgtagcagcattacgtgcacttaatactactactcttaaagaattagtagatgctgctccagcagaagaagcaaagccaagttactacaatgctactgaagaagctcaaaaggcctatactgatgcaatttcaaaaggtaatgacattcttgccgatccaaataattacgatcaagttgacgttgataatgccgtaactgccattcaaaatgctcagaaggctttaactggtaaagaaactgataagaaagcccttcaaaaagcagttgatgacgcatcaaaagtagaatcaagcgataactacactaatgcggatgctaggcttcaaaatgattaccaagctgcaattaaagcaggtcaaggtattttaagtaaagaaaatgctactcaaactgaggtagataatgcattaactaccattaataatgcaaaagatgctttaaatggggatgctaagaaagctgcaagtaaggaagctcttcaaaaggcagttgatgaagcacctactgtaaaatcagatgatgcagcatactacaatggttctgctgaagctaaaactgcttatgacgatgcaatcagtgcaggtcaaatagttttagataatccagatgcaactgctactcaaattactgatgctttaaatgccattaatactgctaagggtaatcttaagggtgaagcaactgataaagcagcgcttcaaacagcagttgacaattctgcaactgtaaaagaaagcaataactatactaatgcagaccaaactcaaaagactgcatatgataaagcagttacagctgcacaaacagttttagataaaactaatgcaactcaagcagaagtgaaccaagctcttcaagatcttgaaactgcaaatcgtaacctaaatggtgatgctaagactgaagctgcaaacaaggctgccttagaagctgctgttaaggatgcgccaaatgtaagaaatacacctgcatactacaacggtagtgaagaaacccaaacagcatataataatgcaattactgctggtcaaacagttttgaatgaagcaaatccatctgcaagtgaagttaagaatgctttagatgcaattaatgcagcaaaagataaccttaaaggtaaggctactaacactgaagctttggaaacggctttaaccaatgctaataatgctaaggaaactggtaattacactaatgccgaccaagcaaatcaagaagcccttaataatgcgattattgctggtcaagagattttaaagaatactagtgcaactcaggcgcaagtagacagtgcagcaaaggctattactgatgcaattagtggtttgaatggggatactaaccttgcaaatgctaagactgctgctactgaagatattcaaaaggctttagatactaagactaccgaaatcactgacgctactaatattgatcaagctactaaggatcaattaattgccgatgctaagaaggcagcagaggatgctaatactgcgattaatcaatcaaccgatactgatacagttaatactgctaaaactgaagggattgctaacatcaataaggtaacagttccaagtttagccgatgctaaaactaaggcagccaaagaaattgatcaagcattaactgataagaccaaggaaatcaataacgctgaaaatattgatcaaacaacaaaagatcagttaattaaagaagcaactgatgcagcaaatacagcaaaggatgctattgaaaaatctacaactaatgacgaagcaactaaagcaggccaagctggtgtagatgcaattaccaatgtaaaggtaccaagcgttactgatagtcaaaatgctgcaaaagaagtaattgatgatgctcttaacgctaagactaaggaaatcaacgatgctaacaatattgatcaaacaactaaggatcaattaatcaaagaggcaaccgatgcagctaataaggctaaagaagccattgataaagcaactacagctgacgcaattaagactgcacaagatgaaggaacaactaatattaataatgttactgttccaagcttggaggatgccaagaaggcagctaataaagcagtagatgatgctcttactgctcaaactgaggtaattaataaagctaataatcttagtgatgcagaaaagaaagatttaattgatcaagtaactgctgaagccaataaggctaaagaaaatattgaaactgctacaacaaacaatgaggcagctcaagctggtcaagctggtgtggatgcaattaagaagattgttccaacaagcttagatactgtgaaatctgatgcaaataaagcaattgacgatgctctaactaagaaattagaagagatcaattccgctaatgatttaactactgatgaaaagactgcattgacacaagaagccaatacagctgcagataaggcaaaagaagaaattaccaatgcaacgactaatgatgctgtaattgaagcacaaaataatggtgttactgcaattgatggcattaaagttccaactgaatcagcagtcaaagaagcagctaagcaggcagtagccgacgcagcaactgcaaagaatcaagcaattgatgcttcaaacttaacagatgaagaaaaagctgccttgaagcaaaaggttactgatgcccaaaatgctgcagatcaagcaattgacaatgcaacaacaaatgcggcagtaactgaagcacaaaccaatggtattaaggcaattaatggtattgaagtaactacctcaactgttaaagaagcagctaagaaggcagtagccgacgcagcaactgcaaagaacaatgcaattgatgcttcaaacttaacagatgaagaaaaagctgccttaaagcaaaaagttacagatgcccaaaatgctgcagatcaagcaattgacaacgcaacaacaaatgtagcagtgactgaagcacaaaccaatggtgtcaatgcaattaatggtattgaagtaccaactacatcagctactaaggaacacgccataactgaccttaatgcggctgttgatgatgctaagaaagcaattgatcaagatagtaacttgactgatgaagagaagcaagcagctaaggatcaaattgatagggatgctactaaagcacaagaagcaatcaataatgccaaaactaacgatgatgttaagaaggcgggtgacgctggtacattagcaattgataaagacgttgctaatgcagccattgataacgcagttgctgggaagaaggccgaaatttccaagaccccattaacagatgaagaaaagactgctttgaacaatgaagtagatcaaaaagctcaagaggctaaagaagcaatcaataatgccactactccagaagcagtaacaactgctcaagacagtggtgttaataacattaatgaaacttcagtgccatctgaatcagcagcaaaacaagcagctaaggaagctgtggctaaggcagttgatgaaaagaatgcagcaattgattcttcaaacttaaccgaagaagaaaaagaagctttgaagcaaaaggttactgaagcacaaacagctgcagatcaagcaattgataatgcaactaccaacgctggagtaactgaagcacaaaccaatggtgtgaatgcaattaatggtattgaagtaccgaataaatcagatgctaaagaacaagccataactgatcttaatactgctgttgataatgctaagaaagcaattgatcaagatagcaacttaacagatgaagaaaaacaagcagctaaagatcaaattgattctgatgctaagaatgctcaagatgccatcaacaatgcaaagactaatgatgatgttaagaaggcagcttatgacggtacattagcaattgataaagacgttgctaatgcagccattgataacgcagtcgctggtaagaaagcagaaatttctaactcatcattaacagacgaagaaaagactgctttaaacaatgaagtcgatcaaaaggcaaatagtgctaaagatgcaattaacaatgcaactactccagaagcagtaactactgcacaaggaaatggcattaagaatatcaatgcaacttccgtaccaactacatcaacagctaaagaagcagctaagaaggcagtagcagaagctgcagaagccaagaacagtgcaatcgactcgtcaaacttaacagatgaagaaaaagctgcattgaaacaaaaagttactgaagcacaaaatggcgcagatcacgctatcgataatgcaactaccaacgcagccgtaactgaagctaaagacaatggtattagtgcaattgacggcattgaagttccaattacatcagctactaaggaacaagccataactgatcttaatacggctgttgatgacgctaagaagacaattgatcaagataacaacttaactgatgaacaaaaacaagcagctaaagatcaaattgattctgatgctaagactgcccaagatgccatcaacaatgctaagactgataatgacgtaaacaatgcagttaacagtggtaaggttgccattaacaaagatgttgctaatgcagctatcgacaatgcagttgctggtaagcttaaggagatccaagatccattaactactgaagaaaaacaagcttacactgatttaattaactctgaagcaactaatgcaaaacaaaatattgctaatgcaactactgttgaagcagtaactactgcacaaacaaatggtgtaaatgaaattactaataccgaaattccaactacttcttccgccaaagaaaaggcaattgctgccatcaatgatgctcttcaaacgaagaccgacgaaatcaacaacgcatctaatatcaacactcaagaaaagactgatttaattaatcaagcaactgaagcagccaatgcagctaagaacaatatcaacaacgccactactaatgctgatgttgatactgcacaaataaagggtgaaaaagcaattgctgatgtaacagttccaaacttgtctgatgttaagaaagaaagtattgatctaattaacaaagctttagatgccaagactaatgaaatcaataatgcttctaacctttctcaagatgaaaagcaaggtttgatcaatgatgcaactaatgccgcaactgaggcaattaacaacgtcaaccaagctcaaacaaatgacgatgctaaagctgctgcaactactggcgttcaaaacatcgaaaacattactattccaactcttgatgaagcgaagaagaacgctaaccaagctattgatgatgcattgaactctaaagtaaatgagattaacaatgcttctaacttgaatgaaactgaaaagcaaaaattagttgatcaggcaaatgaagcagcaactactgctaagaataatgttgaaaaggccactaccaatgatgatgctcgcgatgcagctaatgctggaattgataacattaaaggtattacctttacttcactagaagatgctaaaaatgcagcaaacactgcaattgacaatgctttgcaagttaagacagatgaaattaataatgcatctaacttaagtactgaagaaaagcaagacttaatcaatcaagcaagtgaagtagctaaaaatgcaaaagacaatatcaacaatgcaactaccaatgatgctgtaactgaagcacaaaataagggtattgcagatattgccaatgtgactgttccaagcttagatcaagttaaacaagatgcaatcaatgcaattaagcaagttcaagatgctaagaataagcaaatctctgctgcatctaacttaagcactgaagagcaaaaagaattaagtgatcaagtagataaaattgctaacgatgcaattgctcagattaatgattcatcaactactacaaatgatgcagttactgcaacccgtgatgatgcaatcaagcaaattactgatctatttattccaactctagacggtgcacaaacagatgctcttaatgcaattgaaagtgctaagaatgctaaactaaatgacattaacaacgctactcacttaactgatcaagaaaagcaagctttagttgatcaaaccaataaagtggctgatgatgcaactaaggaaattaaggctgctcaaacaaatgacgcagtcaagagtgcagaaacagctggcttagataacattaataacattgctattccaactttagttcagaagcaacaagaagctattgaagaattgaatgtagcacgtgatgctaagagtagtgcaattgataatgctactgatttaactactgatgaaaagaacagcttgaaagataaagttcaagcagaatacagtaacgcggtatcaaatatcaccagtgcaacaactgatgaagcagtaacaactgctaaagaaaacggcatcgcagcaattaaagacattcaaattccaactaagtcacctgctaaggaacaagcaacaagtgaccttaatactgcagttgatgaagctaagaacgcaatcgatcaagacaacaacttgactgatgaagagaagcaagcagctaaggatcaaattgattctgatgctaagaaggcgcaagaagcaattgataatgctacgactgatgatgaggttaatagtgctgttgataatggtaagcttgccattgataaagatattgctaatgcagcaatcgacaatgcagttgctggtaagaaagcagaaatttctaaatcatccttaacatctgaagaaaaagctgatttaaacaatgaagtcgatcaaaaggctaaagatgctaaagaagcaattaaggctgccactactccagaaactgtaactactgcccaagaaaatggtattaagaatatcaatgatactaaagtaccaactgagtcagcagctaaagaagctgctaagaaggcagtggcagaagctgcagaagccaagaacaatgcaatcgattcttcagacttaacaaatgaagaaaaggctgcattgaagcaagaagttgctgatgcacaaaacgcagcagatagagcaatagatgctgcaactacaaacactgcagtaactgaagcgcaagacaatggtattaaagcaattgagaatgttactgtacctaccgaatcagcagccaaagaaactgctaagaaggcagtagcagaggctgcagaagctaaaaacaatgcaattgattcttcaaacttaacatctgaagaaaaagctgcattgaaacaagaagtagcagaagcacaaaatgctgccaataccgcaattgataacgcaactaccaatgccgcagtaaccgaagcagaagataatggtattaaagcaattaattctattgaagtaccaactaagtcagatgctaaggaacaagcaacaagcgatcttaatagtgctgttgatgaagcgaagaaggcaatcgatcaagatagcaacttgactgatgaagagaaacaagtagctaaagatcaaattgactctgatgctaagaaagcgcaagaagcaattgatactgctaagactaacgatgacgttaagaaggcaatcgatgacggtacattagcaattgataaagacgttgctaatgcagcaatcgataacgcagttgcaggcaagaaggctgaaatttctaagtcaccattaactgatgaagaaaagactgctttgaacaatgaagtagatgaaaaggcaaatagtgctaaagatgctatcaataaggcaactactccagagggagtaactgaagcacaaaatagtggtattaaatccattgatgatgtcaatgtaccaactgagtcagtagctaaggaagcagctaagaaggcagtagccgaagctgcagaagctaagaacaatgcaattgattcttcaaacttaacagacgaagaaaaagctgcattgaagcaagaagttagtgatgcacaaactgctgctaatactgccattgataatgcaattaccaacgcagaagtaactgaagctgaagacaatggtgttaagacaattaatggtattgaagtaccaactaaatcaactactaaagaacaagcaacaaatgatcttaacaacgaagttgaaaatgctaagaaggcaattgatcaagataacaacttaactgatgagcaaaaacaagcagccaaggatcaaattgattcggacgctaagaaagctcaagatgccatcaacaatgctaagaataatgatgatgttaagaaggcagttgatgatggaaaactagtaattgacaaagatgttgccaacgctgccatcgataacgcagttgctggcaagaaggatgaaatttctaaatcaccattaactgatgaagaaaaagctgctttaaacaatgaagttgatcaaaaggcagaagaagctaaggaagcaattaaggctgccactactccaggagctgtaactactgcacaagaaaatggtattaagaatatcaatgagactgaagtaccaactgagtccgtagctaaggaagcagctaagagggcagtagctgaagctgcagacgcaaagaataaagcaattgattcttcaaacttaacagacgaagaaaaagctgcattgaagcaagaagttagtgatgcacaaactgctgctaatactgccattgataatgcaactaccaatgccgcagtaaccgaagcagaagataatggtattaaagcaattaattctattgaagtaccaactaagtcagatgctaaggaacaagcaacaagcgatcttaatagtgctgttgatgaagcgaagaaggcaatcgatcaagatagcaacttgactgatgaagagaaacaagtagctaaagatcaaattgactctgatgctaagaaagcgcaagaagcaattgatactgctaagactaacgatgacgttaagaaggcaatcgatgacggtacattagcaattgataaagacgttgctaatgcagcaatcgataacgcagttgcaggcaagaaggctgaaatttctaagtcaccattaactgatgaagaaaagactgctttgaacaatgaagtagatgaaaaggcaaatagtgctaaagatgctatcaataaggcaactactccagagggagtaactgaagcacaaaatagtggtattaaatccattgatgatgtcaatgtaccaactgaatcagtagctaaagaagcagctaagaaggcagtagccgaagctgcagaagctaagaacaatgcaattgattcttcaaacttaacagacgaagaaaaagctgcattgaagcaagaagttagtgatgcacaaactgctgctaatactgccattgataatgcaattaccaacgcagaagtaactgaagctgaagacaatggtgttaagacaattaatggtattgaagtaccaactaaatcaactactaaagaacaagcaacaaatgatcttaacaacgaagttgaaaatgctaagaaggcaattgatcaagatagcaacttgactgatgaagagaaacaagtagctaaagatcaaattgactctgatgctaagaaagctcaagatgccatcaacaatgctaagactaacgatgacgttaagaaggcaatcgatgatggtacattagcaattgataaagacgttgctaatgcagctatcgacaatgcagttgctggtaagcttaaggaaattaatgattcattaacaaatgaagaaaaacaagcttacactgatctaatcaataatgaagcagataatgcaaaacaaaagattgcagaagcaactactcctgaagaagtaactcgtgctcaagaagaaggagttaagaacattaataatattaacgttccaactacttctccagctaaggacgcagcgaatgctgcaattgatcaggctttgaagaacaagaaggatgaaatcaataatgcaactaacatttcttctgaagaaaagactgatttaattaaacaagcaactgaagctgcaaatattgctaaagacaacatcaacaatgcaactactaattcagaagttgaaactgctcaagttgatggtgaaaaagctattgcggacgttactgttccaggtttatctgacatcaagaaggaaagtattgatcttatcaacaaagccttaaatgaaaagcaagatgaaatcaataacgcttctaacttgagtcaagatgaaaagcaagagcttattgatcaagcaaagaagattgctactgaagcaattaatgaaatcaataatgctcaaactaatgatgaagctaaggaagctgcagatactggagttaagaacattgaaaatgtttcaattccaagtattgaagatgctaagaagaatgcaactcaagcaattgatgatgctttgaattctaagaagaatgaaattaacaacgcatctaacttaactgattcagaaaagactgatttaatcaatcaagcaactgaaattgccaatgctgctaaggatgctatcaacagtgcaacgactaatactgcagttgaagctgccgaatataaaggtgttgctgatattaacaacattcacttcactaacttagacgattctaagaaggcagcaaatagtgcgattgaagatgctttgaacactaagaaggatgaaattaataatgcatctaacttgagtgattcagaaaaggctaagttaatcaatcaagcaactgaaattgccaatgctgctaaggctgcaattaacaatgcaactactaattcggctgttactgcggcagaaaacaagggaattgaagatattgcaaatattaatgttccaagtttagctgaaactaaacaggcagcaattgacgcaattcagcaagttcaaaaagctaagaacagtcaaattgaagaagcaaagaatctaagtgcagacgagcaaaagaacttaattgatcaagtaaataagattgctcaggacgcaattaataagcttaacgatccagcaacaactacaaatgaagttattactgacactcgtgataaagcaattgatcaaattactaacttgttcattccaaccttagatagtgtccaaaaagatgctcaggaagcaattaactctgctcaggaaactaagattgacgaaattaataaggctgataatttaactgatcaaatgaagcaaaacttaattgaccaagtagatcaagttgctgataaggctactaaggccattaataatgctcaaacaaacgatgatgttaaagaagcagaaatcgagggcttagaagatattgatagcattaaagttccaagcttagttgaaagtaaggatgatgctattaaggaaatcaatgatgctttgaagaagaagactgatgaaatcaatgcagctgatcttgatcaaaagcaaaaagacgaattaatcagtcaaattactgatattgctactgagactaagaccaaggtattcaatgctacaactaatgcagaagttgatgctgaagccgaagctggtattaaagccatcgaagctgtgaagattccagctcgtactgctgacaacagcaatactgagagtgaaagtaaggaacaaactgtaattacaaattcagttcaacctaagagaaatgctgttcatcataagaatggcactccagtaaacaagaaggctactttaccacaaactggtaagaaggataactctaacttaacgttagcaggagctgcacttcttggtttagcaggtgtattctcattgtttggattaggagacaagagaaaaaagaataaatagtcaacatcgttgatatgaaaaagagcgatactccctaaagtggaatatcgccttttttgtttggaaatgtaataaaggcagaagcacaattaaatgcttctgcctttattacatgattttattccgcttgactgggaataaaaatgaaattactggtataactacataaagaatcatggcaagtctaggaagaacaaacgatagcccaatgagaacaatatttaaaaataaggtgacagcaacctttctaataaaagatcgactaataataatgttcatgatttgggaatatttcgccgtcttcttagcaccaaaatattgaatcaaatattctaaaattttagcaattaaaaatactattccaaaattagctactgcaaatgttgaactttctgccatgatccattttgtcataactggaagtagagaaaggtcagctaagaaaaagaagtctaagacagcaattgttttctcaggcttaaatatatagtaggaaaatgctaaatgtagatcataccaaaaatcagctacgatgaagaatgtaattaaaaagacaataatatttgcgagaaattgtccatagtggatttcattaatagctggctggatttctaatacaataattgtaataatgattgccattactccatcgttgaaagcttgcaggtgttcacgcaggctttctggttcttcttcttgtgcttgaataagttcttgacgaacagtttttaatttctctttttcttgctttgaaaaatcgttaaaagtatgttcttttctatttcttcttttcattttatctttccttacaatttactaacattagcattttacaatatttaaagattgttattaagatggaaataaataaaatatacatttaagctatagagattgatacattttgaatcttaaacggttaaaaatttttcttttaaaataaatttagtaaagaaaggaatgtttttatgtctatttttgatgaaactttaactatgaataatggtttaaaaattcctaagatggtacttggagtatggaagattccggatgatcagcagttgaagaagcaattaagattggatatcgccatatcgatactgtttaggcttatgggaatgaacgaggagtaggtgaaggagtaagaaactcaggaattgctcgggacaaaatttttattaattcaaaagtcgctgctgaaataaaagattataaaaagacaaaagcatcgattgatgagactttagagaagatgggattaaattatctagatatgatgattattcataattctcaactttggagtgaagtaaatcaatcaacggatcgtcactttgaaggaaatcttgaaacttggcgtgccatggaagacgctgtaaaagaagatttagataatttaatgcagaatagttctactaacctgctgttaatcaaattttagttcacattttttcttgcaagattctagcaaaaagagcaatatttttactatagactattaaagatagaggggaagttaatgcttaagaatattatctttgactttggaaatgtcattatgaactacaatccagatgaaattttaaatcattatgaattgagtcccgaggatcatgatttagttagaaaaactatttttgaatctaaagaatggggcaaaatcgacgctggaaaaattacagaggaagaagccactgaaatttttattagtaaagttccagataagctaaaaagtaaagttaagcaaattatggcaacttggccagaaaatgttgatttctatgagccagtttttaattatatggaggaactacgtaaacaaggctataagatttacggtttatccaatactggaatacagtttgctaattttgttaaaaattctgagatgggcaattattttgatggttatgttttttctgcccaagagaaattaatgaagccagatagaagaatatatgaaagattaattgctcgctatattttaaatccagaagagagtatatttatcgatgatttaaaagcaaacaccgatgcagcaaagaagcttggtatgttagcttttacctttaaaattgataaacttggcgaattacaagaatatatttctaaccattaagtaaattttaggtgattgaaaaatgaaaacaaatgatcaaattgcaaattgggcaatggatttgcagagcctagcgcaagccggattaagatatggccatgatgtttttgatcgtgaacgctatgaagaaattcggcgtattgctggtgaaatgatggctgctaggactggaattccagaagaaaaaattaaaaccttgtttcttggagatgagggatatcaaactcctaaaattgagactcgagctgcaatttttaaagataataaaatcttattagttcgtgaaaaaatgtctcaagaatggtcattgcccggcggctggaacgattatgatcaaactgtcgcagataactgtgttaaagaggcttttgaagaatctggtagaaaagtagaaccaattaaaattattgcagttcaagatcgtaatcatcataataagccaattttagcgactaacgttactaagattttctttttgtgtaaagaattaagtggtacatttactcctaacgatgaaacagatgcttgtgaatactttgctctagataacttgccaaacttatctattgatagaaacacagaagaacaaattgcaatgtgttttgaagcaaataataatccaaattgggatactaagtttgaataaaaatttattacaaaatagctccaagcagtttacttggagctattttaaatgtctattaaaataaaaagaatcaaattaatattgaatttactatttaaaaataatcctaaaggtgagttggaaagcaggacggtaagatatggaaaaaacaaaaattcttttaattgaagatgaggagagcctagctagttttattcaaccagagcttgaattagaaggctatgaggtagtctgggctaaagatggtaaagaaggtcttgaattttttgaaaaagaaaaaccaactttaatccttttagattggatgttacctgtttatgatggcatcactgtcttaagaagaattagaaaagttagtgacattcctattattatgttaactgcccgtaaccaagcttctgacattagtaatgctttagatcaaggcttagacgactatatgaccaagccttttgaaatagaagaacttttcgcccgaattagagtgattcttagaagattagaacgagaaaagagacgggttgtcagttctaccttagaatttagtgttttaaaaattgacttggtttctcataaattttggtgcaagggtgaggaaatctacttaactccaaaagaatatgcattgctatgtgaattaatgaatgatcctgaaaaagttaaaagccgggatgaattattagatatcgtatggggatatgattttgtcggtcaaactaacacagttgatgtctatataagagcgctgcgaaataagttgggaaaatatcgtaatttgattaaaacagttcgtggatatggctattgcttaagaaaggtggacgataatgaataaaaaaataagaacaacttcccaacaattaacacagttgtttctaactttattcattattattctcttcctagttaatttagcatttgctggtatttcaacagcattcatttataataatgctcatgagcaagcagaagaagttattgatacaattagtgataatattagtgaccatgatgagcataagaataaaaatgaatggaaattatttctaaatgcttatcttgctagacaaagtaatgatgcgatttcactgaaaactcctaagggcaagactgtctattcggaagatggggaagaattatttgaaaaagtaaagaatcataggaattacaataatgttgtttttatggaaaatagcgtttattatttacggactgcaaatgaagatggctatcgaatttctgtgattttaaatgttgacgatcttttcaccttaattacccatttattacttgcaatcattattttaaatttaattgccatcatttgttcgattcctttaattaaacgtttttcaagaaaatggagtcagccactagagaaaatagatcaagatattgaggcaattgaacatcaaaccacggcaaaaaagaaagtattcgtgccgaaacaaccagcagaaattcaccacttagcacagtcttttaataaattgctagagtatcaagataaggcaattcagcgtgaacaacaatttgttactgatgcatctcatgaattgaagacgccgcttgctgcaatccgtggccacattaatttgattaaaagacgcggtaaagaacatcccgaaattgtcgcaaagtccctccaatatattgactctgaatcaagtaggatggaaatactggttaatgaacttttggaattaggacgagctaagaaacaacaccaatcaattgatcccattgatctagtgccaatagttcaaaaagagagtgaaattcttgaacaagaatatgatacttgcagcgtctatatttccagtccaataaaacttttttatccaattgaaattaaagattttcgcttaattgttcataatttgttagacaatgcggccaagtattcccaagacaatgccaaaataaaggtagaattgcaaaaagataatgggtacttaattttaagagttaaggatcagggaattggtattagaaaagaaaattatgataagatttttgatcgtttttatcgagaagatcaagctcactctagtcagattaaaggtactggaattggcttagctattgtaaaagatattgtcaccaagtatcatggaaaaattagtgtttcagctaatactcctaaaggggtgatttttgaaataaaattaccactctaatgattaaaatgaaaaaatcttcatttaatttatatctgctcttagttttttcatcctcgttttttcgtaaactaaatatataaagttaagcaataaaaaataaatttgaagaaaaagtgaggattctattatgagaacaaacattaagagattatcattaggcgcagctgttttaggtttagcccttggtggaactagtcttactttaattaatcaagctcaagcatctactggtggacaagctacggaacaaacacaaacttctaactcaatcaatctttctcaaagtgatgcaattaataaatttaatgaaaagtatggctcaaaatcaattaaggagattggactaaagaataagaaaaataaatatatttatgaagtagagggctttgattcagaaaaagaatataaagttaaaattgatgcaagtagtggcaaaattttaaaagctaagtcagaaaacttagatgcagatgataaagaagaggccttagatctaaatggcttaataagccgtagtgaagctacaaaacttgcccaaactaaggcatctggtaaggctgttaagtggtctttagaaatggatgatcagcaaccagtttggaaggttgaattaaaagatggcaataaagaaactgaagttaagattgatgctaaaagtcaaaaaatcttaaagactaagactgatgaagataagaaagatagtgaaaagaaggatcaagtagatcacaaagaaaatagttttagttaaaattcctggaaagccggaagactacactgatgatcaattggcatcccttcaaactttatcagatgtaatggtaactggttatcatgcatctttaaattgtgaggtaaagcctggttacaccgtagccgtaattggggatggcgctgttagtcttgccggtgtaattggtgccaagttattgggtactgaaaaaattattcttttatctcaccatgatgatcgtgcacaattaggtagagaatttggcgcaactgatactgtttctagtcgatacgaagaagctgttaaggatgtgctagccttaaccaaggaaaattctggagccgatgcagtcttagaatgtgttggtgcagaaagtgctattgaacaagctgatcaaattgctcgtcctggtgctgtgattggtagagtgggtgtaccacatgcagaacctaagtcaaaccaattattctggaagaatgtaggtttgcgtggtggtattgcttctacaactaaaccagataaagaagttttattacaagtagttcttgatggcaaaattaatccaggtaaggtatttaccaagagttttgatttagatcatattcaagatgcgtatgaagcaatgagtaatcgtgatgcaattaagtcattaataattgttaataataagtagaatcgcaaaagacaacttaaactttatgtttaggttgtcttttttgcatcttagttatcaattttagccacttagtaataagttattgaaaaatatttgtatgatagtaaaattaaaaccaaataaaaataatgagtgaataataaaacgaggtggctgaaatgtttttcaatacaagtgagaaaacgaagaatgaatatgttaatgaaattttaagtaacgatagttttactgatttgaaacttgatttaattgatctagacctaaaaattaaagcgggagatcattttgaagttcactatcgtggaccagtcgataagaaaccaagtttagtctttaatgaaaacttgcttgaaattaaagaacctaaggtagagcgtaaaccaggtaagttttggaaaaaagggattattgaaataaacatagttacagataaagacaggggagagttagtaattactgtgccagaagatcagcacttacacatgttaaatgcgagctcggtaagtggagattctagtttagaaaatttaaaattagaagctttaatggggtttgcagtaagtggagatttagatttgaagaaggtagaagttgaagatgctaaattaactactacatcgggagatattgattttattaatgtaatagtaaatcacggaaaagttaagttaacgagtggagattttaagatgaaaaatagtgaagtaggcgatgaacttagggtttcaactacttctggggatactttggttgaaaatactaaagtagctcaatatcaactctctactttaagtggggataattcactttttggaaaacgtggtgtagctgcacaaagaggggatgaacatgataaatccacccttattttaagtactctatcaggtgataatacagttagataataaaattgattttttaacaagaaaaaatataaaaaaattgttgacatttatgatgcttatattaaaataattattaacaaatttaattaatctgaaaacaaagagaaagaagagtagtttagtcttaatttacagcgagtctcgttaggtgtgaggagataaattctaaggttaaatgaaaatcactttcgagttctaattcttaatcttgagtaagaagaagtgggagcacccattatagtgctaacgtatcgccaagtaattggccgcacgtgaaaggtattgttagtgataacaatataaataaagggtggtaccacgctgaagcgtccctcaatcaaagtaatttggttgagggactttttttgtattcagatgtttattttctggagggaaagaatatgatgacagattatacatcacgtaaattaacatggaaggactatctcgtagttgcttctttgctattcggtttattctttggggctggtaacctaattttcccattacatttgggacaacttgctggagccaattggggaacagctgctgttggatttttaatcactggtgtattactgcctttattatcagtgttagcagttgcaattacccatgctgatggggtttatgatattggaaagcctttaggtgcaggatttgcagttgtatttatggttttaatccatgctacaattggacctttatttggtactccaagaacagccactgtttcatttacagtcggaatggcaccatttgttcctaagaacatgcaaggaacagccttattagtcttctctgctttattctttttagcagcctttgcattttcttaccatcaaaacaacatcttgtctaacgttggtaaagtattaaatccactatttttatctctattatttttagtattcgttgttgcttttgctcgtcctttgggtaacccacaaactgcagctgtaacaagtgcttacaagcatggagcattagttaacggattcttagaaggctataacacaatggatgctttagcaggtttagcatttggtattacagttgttactgctgttcgtggcatgggacaaaaagatgctaagagcgtatctaaagtagttgctaaatctggtttattggcagttttggctatcggctttatctatttattgttaatcttaatgggtgcaatgtcattaggtcgttttaaggtttccgataacggtggtgttgcatttaaccaaatcgttaatgtttatggcggtgtatttggtcaagccttacttgctttcttattaactgttacttgtttaactactgctgttggattagttgcagcttttgcacaagatttccataagcacttcccacaagtcagctaccatgcttggttggcacttagctgcttagcatcattcttagcagctaactttggattagacacaatcattgcttggtcaactccaatgttgatgttcttatacccattatcaatggtattaatcttattatctgttttttcaccattatttaaaacagatggagttgtttacttctttgtaatcctatttacagttgttcctgctttaggtgacatggtagttgcttttccaagcgttgtaagtcaaagctcatttggtttagctgttgcttctcttagaaataatttgccattagctaatatgggactttcatggctcgtaccagctttggttggtttagtagttggattagttgttcattttgttaaatctaaaaaagtagcttccgttttagaagaagattaaatatttagctctgctgaaaatcagcagagcttttttgataaataaataaagtttacttgttattagaatagggctaagaacttctaatcaaaagtcaagactaaaattatagctttaataggattaatattatctatatgttgtatgttagctagagctgataacactaaatatagaatgataaaaggtgaggatttacatggctacgttagaaattaaagatttacatgttgaagttgaggataaggataagaagagtagaaaaaagatccttaaaggcgtgaatttaagtctgaaaactggtgaaatccacgcaattatggggcctaatggaacaggaaaatctactttatctgaaacaattatgggaaatccccgctaccatgttactcaaggagatattctgttaaataatgaaagcattgttgaaatgcccgtagatgagcgagctcgtaaggggctatttctagcaatgcagtatccagcagaggtacctggtgtaactaatgcagaatttttacgtgctgcaattaatgctcgtcgaccaaaagatgatccaatatcagtgatgactttcttgaatgaattggataagaatcttgatttgttagatatgaatgaggccatgactgaacgatatcttaatgaaggattttcaggtggagaaaagaaacgtaatgaaattttacagatgctaatgattaaaccaagttttggaattttagatgaaattgattctggccttgatattgatgcattacgagtagtatcgcgtggagttaatgcaatgcgaggagataattttggtgctttaatgataacgcactatcaacgtttgcttgattacatcgtcccagatattgtacatgtcatgatggatggacgagttgtaaaagatggaggtcctgatttagctaagaagcttgaacaagagggatatgcaggtttacgtgacgaacttggcttagatattaaattagttgatgagaattaggagtgcttatgctaactaaagaaaatttgcttaatttttctcataaaaataatgagtcctcatggttaactgatttaagaattaaatcctttgaaagactagaagaactggattatcctaaaatgcagcgattttcttatcacgattggcctttaattaaaaaagaagattttccctggtctaatcaagctgacttttctttaaaagaggagcagaagcttttagaaaagaaaggcatcattttaaccgatatttttacagcaagtaaaaaatatcccgaacttgtgcagtcaactttagggtcagtaattaaacataatgaagataaattaactgcctatcattatgcctacttaaattctggacttttcctctatattcctaaagatactatcttaaccgaaccgattacaatttctttaagtccaactcaagatacctatatttctcaccttttaatcgttgccgataataatagtaaagtaaaatttttagaagaaattcaagataaggataaaaaagcaagttcagccagtttaatggtggagcttatagcacgtcctgggagtcatattgaattctcttcacttgatgaacttagccaagacacaacgctttactttaatcgtcgagcaaaaattgaaaaagacgcccatgttgaatgggcaattgcttttatgaacgattgcaatacactgggagatcttgattctgagttagttggggaaggaagctttgcggattctaaggccatcgcagttaccacaggagatcaaagagtgggcataaataaccgcgtaactaatcgtggtccgcactcaactggattaattaatcaacgtggggtcttactagaaaattccaggttgatcttcaatggaattggtcaaattgtgcatggtgcacatggctcaaaagctgatcaacaaaatagagtcctaatgatgtcggatgaagctcatggggatgctaatccattacttttaattgatgaaaatgacgttattgcagctcatgctgctagtgttggtccagttgataaagtccaaatgaactatttaatgagtcgaggaattccttacgatcaggcacaaagattagttatacgtggctttttaggtgcggttttagatgcaattccaaataaagatgttcgcagaaaaatgattgatattctagagagaaaactgatcgatggccaaattaaacactgaaaaaataaagcaggattttccaatttttaatcaaaagattaatgatgaaactcttgtttatctagataatgctgcaactagccaaataccgaagtttgttgaagaaaaagttagagattttaatgaaaaagaacgtgcaaatgtccatcgcggagtccatgcattaggcttaagagctactaatcaatatgaatcaagccgtcaaaaggtggctaattttattggcgcaaataatgctaaagaagttatttttacttctggatgtactgatagtttaaatttagttgcagctagcttcggtgaacaaaatattcaggcaggggatgagatcctagtctcaattatggaacatcatagtaatcttttgccttggcagcaacttgctaaaagaaaacaggctaagttaaattttattgaaataaattcagatggcttacttgatattaaaaatttaaaaagtaagatcaattcaaaaactaaaattgttgccttgacgcatgtaagcaatgttttgggcacaattaatccaattaaggagcttactgatctagctcatgaaaaaggagcaattgttgtagttgatggtgcacaagcagttggacattttccaattgatgtagctgaattaaatgtagatttctatgctttttctggccataaaatgtttgctccgacaggaattggtgttttatatgggaaaaaagatctcttagataaaatgcagccttatcgtttgggtggtgaaatgattgctaatgtaactagagaaggagcaacatgggcagaagtaccatataaatttgaagctggtacaccaaatattgctggtgccattggacttggagcagcaattgattatctgcagtctctagactttgagcttattcaaaaacatgaacaggaattgacaagttatgccttagaaaagcttaaaaatgtttcaggattaacaatctatggtccacaaaaaagtaatggtcgcattggagtaatatcttttaatttaaagaatattcatccccatgacttagcgactgcactagatttaaacggaattgaagttcgtgctggccatcattgtgctcagccgctaatggctagccttaatacggagtcaactgttcgagctagtttatctatttataatactaaagatgatattgataaattagtaagttctctccatgaagcaaaggagtttttcagtgagtttagataaattaagaagtttatataaagctgtaattttagatcatgctcaaatgccgcgaaattatggacaactaactgactttagtcatgaaactactgtatataatccaagttgcggtgataaaattcatctgacaattttgattgaaaataataaaattaaaaaaattgcttttaacggcgaagggtgcacaatcagtaaagcgtctgccagtatgatgacagacttggtaaaaggaaaaagtatcaaagaggcaattgagctttcacacctattttcaaacttagcagccgacaagaaaagcgacactttaaaattagaacaattaggagatgctcaagtattagtaaatattatgcaatttccggcccgaatcaaatgtgctactttagcatggtggggactagatcgagcattacttggtaaagaaaaggaagaagaaaatgactaaagcagaggatatagttaaagacgaagattatcagttcggctttcacgataatgtagaaccgaaattttcaactggtcgtggcttaacagaagaagtagttcgacaaatttcagcagaaaaacatgaacctaaatggatgttagattatcgtttaaaggcttttcatatttatgaaaaaatgccaatgccagattttggtcccgatctttcagggcttgatttagataatatgctgtattatcaaaaaatgaccgataaaaaatatcgtgattggaaggatgtaccacaagatattaaggatacttttgagcgacttggtgtaccgcaagcagagcgaaaatacttagcgggttcggctgcccaatatgaatcggaaatggtttatcataaaatgaaagaacaatttgataaactagggatcatcttcactgatacggatacagctttgcaggagtatcctgatttattcaaaaaatactttggtaagttagttccaattgattcaaataaattttctgccttaaactgtgctgtttggtcaggaggaacttttatttatgtgccaaaaggagtacaagttccaacaccagttcaggcatattttagattaaatgcagaaaattcaggccagtttgaaagaactttgatcattgttgatgaggacgcgcatcttgattatgttgaaggatgtactgctccgcaatactcttcagattctttacatgcggcagttgttgaagtaaatgtcttagataatgcatattgtcgttatactacaattcaaaactggtctgataacgtctatagtctagaaacaaagcgtgcagttgctggaaagcatgcaactatggaatgggtagacggtaatttaggtgcgaaagttaccatgaaatatccaagtgtctatttaaacggtgaaggtgctcgcggtactatgctttcaattgcagttgcccatcacggtattcaccaagattctggagctggaatgtttcataatgctcctaatacttctagctcaattgtgtccaagtcaattgctaagggcggtgggtcaacagattatcgcggtagtgttaagttttctaaaaaatcagatggctcaaaggctcatgtggaatgtgacacgattattatggatgatatgtcttcttctgatacgatcccaactaatgctattgaaaattcaaatgtagcgatggaacatgaagccacagtttctaaaatttctgaagaccagctgtattatttagaaagtcgtggcatcccagaaagaaaagcaactgaaatgattattatgggctttgttgaaccctttactaagcaattaccaatggaatatgcagtcgaacttaatcgcttgattagcttccaaatggaaggagcaattggatagtgctagaaatagagaaattatctaataccgaaaaggaagtttaccaagccttaaaaaaagtaattgatccagaacttcaggttaacatcgttgatttaggattaatttatggtattgaagtaagcgagacaaaatgtcagattacgatgactttaacgattatgggatgtcctctaagtgagtggttagatcacgaaattactaaagctgccaaaagtattgatgaagttgatgagtgccaaattaaactcgtttggtatccgcaatggaatccaagtatgatgtctagagtggcccggatgacccttggaattcatggataggggtaaagatggaagatcatagttttatttcatacgcaaatggtaaatctttagtagaaattaatagtactattccagttccgagaactcgtaatttcttcaggatgcttttagcatatactggtcctggtgcattagttgctgttggatacatggatccaggaaactgggcagcttcaattaatggtggtcagagttttaattatcttttgatttctactattttaatttctagtttaatggctatgcttttacaatatatggccgcaaaactaggaatcgttactcaaatggatctagcacaagccattcgtgcacgtactagtaaaagattaagttttatcctttggattataattgaactagcaattatggcaactgatgtagcggaagttattggagcggcaattgctttaaatcttttatttaagattcccctagttattgcaacttttatcactgtctttgatgtattactcttattgttattgtcaaaagtgggatttagaaaaatagaagccctggtatcctgcttgattatggtgatactactggtttttacttatcaagtcatgttagctaatcctaactggaaaaatatttttttgtctgcattgccatctccagaattagtagctcagcatcccgtagttaatggattatcacctttaacaggaagtttgggaataattggtgccactgtgatgccgcataatttttatttgcattcatctatttgccaaactagaaaaattaaccatgataatcttgcagatgttcaaaatgcagtccgttttactacgtgggattcaaatattcaattaattattgccttttttgttaatgtacttttattaattatgggagctgctgtttttaaaagtggtgcagtcaaagatagttcattctttggtttgtatgatgctctaagcaatacgactatgttaagcaatccaattttgatctcagtagctaagacaggaattttatcagtcttatttgcagttgcacttcttgcttctggtcaaaattcaacaattactggaactctcactggacaggtagtaatggaaggctttattcacttaaagatgccactatgggcaagacgattatttactagattattatctgtgattccagttattatgtgtgtattgatgacagcaaaagattcaatttctcagcaacattttgccctaaacatgcttttggaaaattctcaagtttttctagcatttgcagtaccattttcaattgtgccacttttaattatgacagatgataggagaatgatgggacaatttaagaatagaaagatttggtcgattctaggatgggccagttcaattattttgattttcttgaatttgtgtaatttaccagctacttttgtttcctttaatatgatgccaaaaagagatgcagtagttttcgcttacacgatcattatgttgattattttattaatgggctggacatgttgggatatgcgaaagaagaaatagttttaatatctttaataattgggttaatattaagagaataataatttaaatagatcggattaataaaaatgatttatcaaacttttgcccaattatatgatcagttgtttgattcagatatgtacaagagctgggagaaattcactttagctaatattaataaaaagaatggtaagctactcgacctagctggtggtagtggacgattagctgttttacttgctaaagatggtataaatgtcacggtagctgatttttctgatgaaatgcttagtttagcagatcaacatagtactgaaaataatgtttctttacagttggtgcaagctgatatgcgagatttaagtggccttgaaaaattcgatgtaattacttgctatgcggactcttcctgttatcttgatgacgaagctgacttgtttcaagtattttctgaggtcgccaatcatttaaaagatgatggtgtatttcttttcgatgtaattacacctcatcaaactgacgatatttacccaggctatatgtacaattatcaagatgatgatcatcgtcgagcatttatgtggcagagttatgccaatgatgatgtcgaacatggggtgatccatgatctaacattctttaatcgtctacccaatggcgaatatgatcgtttatctgaaactcactatgaaagagcatatgatttagataccattaaacagttattgaaacatgctggatttaactcaattgaagttggatctgactttagtctagaaatgaaagataaaaaggcaactcgctggttctttaagtgtcaaaaataataaaagtatccagggaaaaacattaaaataaagcactgataatcatcgttaaataaacgttgatatatcagtgcttttactttctaaagagttatgttttaaatcaaattaagacttgtttacgaaactctttttatgccgcatatgcggatttgtataaatctctagcggcattaatatcttgctcttgaatagaataataggatcctgccggatacattacagaagctatattagtatgttgtaagccaattgcatgacctaattcatcattatttgaaatatcaataaagacatttgctttagcatggttccaagtctggttgctggaagtctcttgattttgtccttcactaaaattagaagttactggctgatttggctattggttatctgattccgaggatagcgtctgatcagaaggtcgatcggaaactttaggtggaactatctttaatggattaagatcgctagcatctaaggttgatattttttcctttaatgtactaattgaatcgttagtagccatgtgaacagtaggattattcttataagtattaacacctacagaaacaagacctaatagaagaaagagcttaatcgtttttctgacacttctcatgtaactgttatcacctccattcgacaacaagtttatttgggagatgtgaataattaatggtgaaatagttatatatttttagtgaaagttaactttttcttagtaagtagtaaaaaatactatgcacttagcgtatgagaataaaggttacttcatgttctatttttttatttaaagttgcatataagacaagttaaaggaatttattgcattttaagactacaatagaaagtgaaaacatttttgagaagagaaggaaactaagatgtgtacatcaattttatatagtccaaaagataattattttggtagaaatttagattatgaaattgcctatggtcagaaagtggtaattactcctagaaattatcaacttaattaccgacatttaccaacacaagatactcattatgcaatgatcggtgtttcagtagtcgccaatgactatccattatattgtgatgctatcaatgaaaagggactagggatagccggattaaatttcactggtcctggtaaatatttttctgtagatgaaagtaaaaagaatgttacttcttttgaactgatcccatatttactaagtaattgcgaaactatcgaagatgtaaagaaattattatctgaaactaatattactgatgaaagtttctctaaagatttaccagttactactcttcattggttaatgggtgataaaagtggtaagagtatagtcattgaatcaacagaaactggcttacacgtttatgacaacccagttaatactttaacaaataatcctgtctttccagctcaagttgaaaccttggctaactttgcttcagtttctccagctcaacctaagaatacccttgtacctaatgcagatattaatctgtatagccgtggattagggacccatcatttaccaggcggaacagattcaaattctcgctttattaaggcatcttttgtattagctcattctccaaaaggtaatgatgaagtcgaaaatgtaactaatttcttccatgtcttacattcagttgaacaagcaaagggtacagatgaagttgaagataatgtatttgaatttaccatgtattcagactgtatgaatttggataaaggaattttatactttactacttacgataataaccaaattaatgctgtggatatgaataatgaagatttaggtacttctgacttgatcacttatgaattatttaaggatcaagccattaaatttgaaaattaaaagttagtttaaaataatttagtagtaaattttgacaaagtaaaacgggtgaagttgattggctccacccgttttgatttgttatttagggttgataagattttatctttcacaagtttaaacctaaaaaattctagatgaattttaaaatttatctaaaatcatctcttgttcaacacatttatcgaagtagggcaataaaaagctaacatagccataaccattcggtttaataatttggtcatcaattaatttccggcgatagacagcaatgtaattaggtcctttttccataagattaccaataacctgacttttaaccttgtgttgcttagatttaaccatagcttgtacgaattctttttcacgttcagacatgtcactataaactttgaagtaaacatttctatttaattcactaatatagatgtctaagatgttgtttatatcagatatagaaatcgtcttattggaggaatgaatgatttcttcccacaaatgatagcccaataattgaaaagcgtaagcaaatccttgagtttgtttagtcatatataaaagagtttcagtagaaaacgtatagccagctttactaaaaatgtgctgataactattttttatactttcaatatctaaaggatttaagacaattcgattggcacgtaatagaaaggtaagaacatcatcattttggatttctgaaacattttctggtaaaccggccataagcaaagaaacattaagattgtttcgaatcataatttgataacaactagcaaacttttttaataatggagttaaatggacttcatcaatgttaattaaaacatgaaacccttttttcgttagtttttctaaggcatcttggaataataattgaaaattagattcagcctgttgatggaaactagcactcatatctagtccaaagaagtttatctttaggtcgatatttttataatcttcaagttaagaagatgcctttgtaattgatttattagggagattaagagatcatcatctagaactaaattgattactaaccaatttttatatctacttattaaattagaaacttctgtcatcaatgtggtttttcccgaaccacgttgtccgtaaagaagggatgtttgaaaaggcaagcccactctatttaattcattaactatacgttgagttaatgagtcacgatttaagaaaacactgggcatttttccaaaactaggattaaaaggattttccatttagttacacctctttttataactttttataactttcgcttaattttataactttttataactttttttcagttcggaagaagttgttggagagaacgaataattctatattgtaagaaaaaactacacataatatatatgaaaacaaaagtttaacaactgagtaaaaagtttcctataatatatagatgtaaattatagaaatgataaagaaggaaataaaatggcagtcccaaaaaagattgaagttcgtggtggacgtgttcataacttgaagaatattaatgtagatatcccacttcataagtttgtggctatttcaggactttcggggtcaggaaagtcatccctggcaatggggattttatatgaagaagggtcgcgccgttacttggatgctctatctacctatatgcgtcgacggattaagcaaggtgcgcaagcggatgtaactagtgtaaaacatattccatctgccttagccttgcgccaaagaccaagtgttcctaatgaacgagcgactgttggaacaactactgaaacatataatgttttacggctaattttttcaagattaggttcaccggtttgtccgaatggacaccgagttgccccaagtttagatattgcagaagcaatgtctaagtccggagatgagatggggcaggttacttgtccaacttgtggtgtaaagtttcacgttccaagtgcggaagatttttcttttaattctgatggagcttgtgagcgttgcggtggaactggtaaggtacgccaattagacgaaagtaaattaattaccgatcccaatctttcgattagaaacggtgctgtagcttcttggaatttaccaggaaggaactttatgccaaatgtggctgaacatgcgggcgttagaattgacattccttataaggatttaactgagaaagagaaagattttgttttaaatggtcctgaaaagaagtaccagatggatttgttgtcaggaaccggtcgagtttttcataattttaatgctttatatgaaaatgcgcatcaagccgttttaaaatcagctgaaagtagtaaaagtgaacgagcacagaaacgtcttgcagaattttttacttattcaacttgtccggtttgtcatggaacgcgtcttcgtccagaactacttaatcagttagttaatggaaaaaatattgatcaagttcaacatatgcaactaggcgatttgcctaaatggagtaaagaagttctcgctagtctaccagaaaatatgcatcccatggctaaagccttactcaatgaatttattaataatttgcagccattactggatttaggattagattatttaaccatggcacgagctgggaataccttgtctactggtgaattacaaagaatccaacttgctagaactttacgtacagaaactaccggagttttatacgttttagatgaaccttcaattggattacatcctgctaatgttgatggattaattaaagtattgcgtaaattagttgcacaaggtaattcccttgtggtcgttgatcataatgttgatattataaaagcagctgatgaaattattgaaattggtcctggttctggtgaagctggaggagaaattttggatcaaggcactcctttagaaattgaaaaagatcctcaatctttaattgcaccttatttagatggcaaagctgatttaatggctcgtaaagttagcgataaagttaattctgagcaagttactttcgaagtagatcactattttaatttacatgatattaaagcaggcattcctgtaaatcaaattactgctgtaactggcttttcaggagcaggtaagactagtttgattttagattctattgttccagcaattaaggcccaagataaaggagagcctttaccaaagcaagttaaagaatttaattctccgatacatcatgttgtaagtgtggatgcttctccacttggaaagagtacgcgttcaacagtcgcaacttatacttcaattatggataatttgcgtaagctctttgctcagcaacctttagctaaagaaaagcactatactcccagttacttttcttataataataaagaaggagcttgtccaacttgtggtggtacaggaatcgttactttagatattcagtttttgcctgatatgcagcaaacctgtcctacttgccatggagatagatataatcaaaaaattcaaaaagttaaatggcatgatctttcgattgttgatgttcttaacctggatataaacgaagctattccaatttttaaagagattccaaaaattgaacgcgatctacttttattgaaagaagtaggtcttgattatttacacttaggagaaagtacaccaactttgtctggtggagaagcacagagattaaagttagtaacacacttaagtcaaagacaagacgataccttatttgtttttgatgaacctactattggtctgcaccccttagatgtaaaggtattagttcatgtaatgcaaaaacttcttgatcaaggcgcaacaattattactattacgcatgatcttaacttaatcgttaatactgactacatgcttgatttaggaccacgtggtggtgaaaatggaggaaagttagtggctaaaggtagaccattagaattaattaaagatccgcaaagcttgaccgtaaagtatttagcagattatgtcgatcagtttaaattaaataaaataaacagttaataagaagtcgccaatctaagaattgtagtgaccctcgaaattcggacacgaatttcggggggttcttataaccaaattatctaaagaagataaaaagtattatattgaagcctatatatttttcatccttgttaattagttaaaattgttaaataattttgtataataaagtggcaattcagtaaagtttgagaggatggaagcatagtatggaaaagttaaaagcaattcaatttaattttgaaaattgtgagtctgagcaaattccaattgagtatattccttattttaattttaaaaatgtatatactaacttaagccatcgctggggccatgaagaggaagatagtgatgtccttaaaacaggccttgaatgtgatgggtttactatgattgctgactgggataaagtaaataccattgaaacttcggaagaatataatttagctgaccggatagctaaatttcatgatttagttgatgtagatttgatttttaaatctggaaaagctaaaaatatttatatgccatgggaagatgcgaactatggtgaatctaacgctttaatgattgtcctaaagtctgattctagttcttatgttactaatagtaggttcaacaatagtacatttttagaagtttatatagagaaaaaggcgtaggccaatatctttttagatattaggcatgcgcctttttattagtctttgaatatggttaaaaatctattattttcgaataaatttttgatcactgcttggaataccattctcgtcagaaatataacgttctacacgcatatgaagatcatacttcttacgtaagtcggctaattcttgcatcattggtgaagcatggtgggcatcaagagattcttgatttttccagctatcaattagaagaatagtttcaggatcatctaatggaatgaaatattcatatttttcatttcctggttctttcctaatacggtcggctacaccgctgctttccatttcttcagcgaatttacgagcgcttctatttttaccagtgtagtaaagattaactgttaatgacatatctaatcctccttaattattcgtagtagttctttaaccattttatattaaattttaatcaagaaaaaagtgtttaccatcaagactttaaaatctggtaaacgctttttctataaactgattttgataaacattaatgcaattgttttaattcgtttaatactgcatcatagtttggctcatgtgtaatttcatcaactaattcacggtatagaattttcccattaggatcgaggacccaaacagaacgagcaagaataccggattcaggaattaataagccagttgccttaccaaatgaaaaatttttatcagacatcaattgcatatttttaacatcttcggcagcacaccaagtttgctggtcttcaaccgtattagttgaaatagtcaaaaagttaatttctggaaatttatccattgttttattaaaagttttggtttgaatactgcaaacaggagtattaatatctggtactacactaattaaactaaatttacctaacaaatcagacttagtgaattcttgattgttcttatttagtactgcaaaattaggcatttcttcaccaactgctggcggagtacctattaatttaacttctttacctttaaaagtgattttcataagttataccctctctttctttttattatcttaaatatagcaaattatagaaattatcttaaatatttagcctaggtagtaaaagaccataccttaaatgcatagatgtctagtagaaataactatttttaatttataaagggtggatataaaataatagatgagagaaataaagagtttgacggaggaaaaaataatggcaaaaaatgaagaagaagtaaaaaatagtgtctttggctttggtaaatttaatgaagcatacgcaaaatactttcaaggaaagagttttcttaatcctttagctacaagtaaagaggcaaaaactggtgtcagcaatgtaagttttgagcctggatgtcgcaacgattggcacatgcactcaattcctcaaatcctaattgccgttgcaggtgaaggttggtatcaagaagaaggtaaaccagcacagaagatggttcccggtgatgttgtaattgttaaccctaatactaaacactggcatggtgctaccaaggattcatggtttgctcatgtagcagtaatggtcggagagggtaaaactacatggcttgagccagtttctgatgaagaatatgacaagttaggttaaatttaatagagtttatattaatgaattaggtagataaaaagttaagtactgactgtagtacttaacttttttcgtaaacttgataatttctttaaagaatacttgaagtaaaatatttcgatttttttaagaaagtaaagaaattataaagacggttgaataataaaaaatagtcgtttaggctatagtcgttaattaaataaagaagcaaataaactgttaggtgagactcctacgtaaatatatgctgatgcccaggaacatccagagatgccaacgggtcaaacaggaactgtcgagttaagtcttttcccagtcagctagttgaaaaaactttacgttacgtagtgttaaaactgaacgacgagtattaaatcgctattataagaccaatgcagtttttgcgttggtctttttgtttgtttgccgattttttagagggagagattactatgttaaaattcaactctaaagatcgtgtagtaactgatgcgactttagctaagcaaattgctggaaaagaaaagagtgaagtattaaagcaattagatacgtcaattaatgggttaaaccctgcgcaagcaaaaaagcgtttagagcgcgatgggttaaatgaagtatcaaataaagagtgtcatccaaaattgcattttttatttgatgctttcatgactccatttacaggagtattactgtttttagctcttttatcttttttgactaactatctttttgttcctgcagatcaaaaggatctcagtacagtcattattatgattacaatggttttaatttctggaataactagttttatccaaaacgttaaaaccagtgacgcagttgattcactattaaatatggtatctgtaactacgaatatcaaacgagatggaaaagatcaggaattgccaactaaagatgttgtagttggtgatatcatcaatctaactgctggagatctagtaccagcagatctgtatttattaaaaagtaaggatctcttttgttcagcaagttcattaaatggtgaatctagtcctgttgaaaaactagcagatgaaaagccaaaggaaaatgataactatctagattatccgaatattttatatgagggaacaaatattgtttcaggctctgcaatgggtgttgtatttgctacaggtgatgagacagtttttggtaatttagcacgtactcttagcaagaataaaaataaagaaacaacttttgatattggaatcaaaaatgtttcaaagattttattgattatgaccgctgtaattgcacctcttgtgtttttaattaatggtctgaccaaaggtgattggcttaatgcattgatttttgctattgctacagctgtgggactaactccagaaatgcttcctgtaattgttacaagcaatctagttaagggatcagttgaaatggcaaggcacgaaaccattgttaaaagaatgaattcaattcaaaactttggctccgctgatattctttgcacagataaaactggaactttaacacaagacaaagtagttttagagcgtcactatgatttgaatttagaagaaaaatcaaaagtcttagaactatcatatttgaacagttactatcaaacagggatgaaagacttaattgataaggcgatcattgatgcagctaaaggtgaattagatacaaatgacattaatcaaaattatcaaaaaattgatgagattccctttgactttaaaagaagacgaatgagtgtagtggtaatgaataagaagcatgaacacttattagtaacaaaaggggctgctgaagaaatgcttgcttgttctaaccggttagaaattaatggtgaaattagggctcttaatcaagagcaaagacaagaaattttaaataagatcaatcaaatgaaccaagatgggttacgggtggtattgctagcctataagaaaaatcctgctcctgttggtgaattcagtgttgatgatgagaaagaactaattttaactggatttttagcatttttagatccaccaaaggatagtgctaaagctgcattaactgctttaaagagggatggaattactgtaaaaatcttaactggagataatgaagctgtcactagaaatgttggcaaacaagttgggttagatattgcttgcgtgtatcagggaaaggacttagaaaataaaagttcagctgaattgaagaaaatggttgaagaatgtgatgtttttgtaaaactatctcctcaacaaaaggcacaaattattcaattattaagagaaaataaccatactgttgcttatatgggagacggaattaatgatgcgccggctatgaaagcggctgatgttgctatttccgttgatacagccatagacattgctaaaaaatctgctgatataattttgttacacaaagacctaatgattttagagaaaggtgttcaaattggtcggcaagtctttggaaatacgatgaaatatattaaaattacgctttcatctaattttggtaatattttatcaattttagtagcatcctcatttcttccttttcttccaatgcttccagttcaacttctcattttagatttaatgtacggtaccagctgtctatcaattccattcgatacaatgaacaaacattatttatctgaaccaagaaagtggagtactaagaagcttcctaagtttatgttctattttggtcctacatcttcgatttttgacatcataacttttgcattactgttctttatagtttgtccacaaattatcggaagtagctatgcaggagcaactgcttcacaaaaattacttttttcagctgtcttttgtactggctggtttattgaatcgctttggacccaagaaatggttattcatgcacttagagatccaggcctcccatttattaaacagcatgctacagcaattgttacatgggcaacgattggtatggctgcaattgggactatgttaccatttattattcctgtcgcaaaagcagtgaaatttggtccaattccagtatattttttaggaattgtatttattttattgattttatacattgctttaacgatgttagtaaagaaatggtatctaaaatcagagaaatatttaatctaattgttttaatattaaatctatttttaaaggaagtatgatttactacatacttccttttgttttattgtggcatattttataattaggtatctaacagtatacattctaactattaacaaaggggttaaaagatgacagataaagtagaaaaatatcaagaaatgatggatttattccgtttatacttcaacttttctaaaagattttatggggaagaagtaaaatttagtcaacttactcctcaacaaggacgaactttaatgtatattcaagcgcatcccggtatgattcagcgagaactagctgataattttcacttacgtaatgccagtgtaactaatatgttgaaaaatcttgaacgtgatggatatattcaacgcaaacaagatgaaaagtctgcccgaattaaacgaatttatcttacccacttaggcgaaaaacaagttattgagatgaaaaaaagttttaacttgatattaaaaaaactttctagtcgagtagacgaaaagctattagatcaattaataccactcctgaaggaactaaaccaacaagttcgaaataattagtgacttgacagttaggtatctacatgttttaatactaagcgtcaatcattattaggtacctaactattaaggaggaatttattaatggatagaggaagaccccggattgaaaaaggaaaacatagttttagttttcaagatttttttaaattaataaatcgagtgcatcccaaatattggcaattaattgttggtattctggctggcttaattgccacgggagcaaacttaattgttcctcaatttgcacaaagaattattaataactttaagcatttaaatataaacctggtaattattactggaatagtattttttggtggagtaattattagtgccttatctggttatattttgggagtttttggagagcatgtggtttcgaaacttcgtgataatctctgggctcgcttacttaagatgccagttagttattttgataatacttcgacaggtgaaatttcatcaagactagttaatgacacgtcacaagtcaagaatttacttgctaataccttgccgaatgcaattacttctttattacaattctttggtgctgtcgtcatcatgtttatgatggattggcagatgtccttaatcatggttcttgctgttcctttagtgatatttgtcctactaccatttatgagattgtcaggaaaaattggccgggcacgtcaagatgaactggcaaaattttctagtgattcaactaatgttttaagtgagatccgtttggtaaaatcaagtaattcagagaagaaagagcttgctacaggaacaaaaagaattgctaaactttatgcaattggggtaaaggaatcctggattaactccttgatgcagccaatttctaatatgttaatgatgattttagtaattggtattttaacttacggtgctattcgtgtcatgcaaggtacacttactatgggtgcacttatttccttcttaatgtatctatttcaattgatgggtccagtaatcataattagtcaatttttcaatgaattagctaagacgtcaggttcaactgaacgtatcggcgaaatgcttaatgaaccaattgaagtatctgccgataatcaaaaggttgatattgctggaaaagaattgaagttgcagaatgtaagtttctcatatgaaaaaggaaagcaaattctacatgatatcaatgtgtcggcgaagcctaatactgttgtcgcatttgctggtccatcaggtggtggaaaatcaacaattttttcattaatagaacggttctataaaccaacttcgggaaagataactattggtggtcaaaatatagaagagattgatttaactgattggcgtaaacaaattggacttgtaggtcaaaattcatcagtaatgccaggaactattcgcgaaaatcttgtttatggactaggaagaaaagttagtgacgatgaattatggcatgttttaaagatggcatatgcagataaatttgtaaaagaggcagaagatggcttagaaacacagattggtgaacgaggcgtgaagctatcaggtggacaaagacagagaattgcaattgccagagcttttttacgtgatcctaaaatcttaatgcttgatgaggctactgcaagtcttgattcagaatctgaagctatggtacaaaaagctttagcaagtttgatgaaaaacagaatgactttagtaatcgcacaccggctaagtacaattgttgatgcagataaaatttattttattgaccatggaactgtttccggctcaggtactcatgatgaactagtaaaatcgacacccctttatgcagaatacgttcataatcaatttaaaaaatagtagataaaaatagcggcttttaagtcgctattttttgtataaattaaaataagagttttatttattcttttaggatatgattatcatatggaagtaaaatagtgaattaacatagaggtaattatgaaacatttaacgttaaataacggtgttaaaatcccgatttttggctttggaacttacgagattagcccagaccaaacaaaagaagctgttttatctgcttttaaagatggctaccgtttaattgatacagcacaatattatcaaaatgaacagcaggtaggggaagcagtccgcgcaagtaatcttaatcgggatgaagttttcattactacaaagaccatgactgatggatatgaagcgactaagcagggactagatgaatctctaaataaaagtggcttagattattttgatttagtcttaattcattggccaatgggccacgatttagatacttggcgcgctctagaagaagcatataaagctggtaaaacgcgagctattggtatcagtaattttaatagtcgacaaactttagaattaattaatcatgcagaaattcggcccatggttgatcagattgaaacacatcttttattacaacaatggaaaatgcacgaatttttgaaaaaagaaaatattattcatgaaagctatagtcccttaggtaacggtcaacaaaatctgatgactaatccagtgttacaaaaaattggtgaaaaatatggtaaatcaccaatccaagtgattttacggtatttagtccagaatgacattgtaactattcctcgttctactaatccagctcatattaaagctaatattgatatctttgattttgagttagataaagaagatcttaagcaactttgtgctttagacgagcgtaagccaattgatggctggccagcagaaatgagagaagatgaggattattaagtcatagaacataacataaaagagtaattgtattcccatagatagaatgaggtagacaattactctttttcactattcatttaattattaagcgagtctcgtaatttttctaaaaataagtttcctaaattagatagctttcgattcttcttcccgataacgatattaggatcagtaattttgggagaaagagggcgagcagttaaaccctctagtttcttatcatataaattattgtaagaaatttgaacgctatgaccttcaccagctaaaagagacgcagtataagctaaattactgtttgcaaccgttaaatcagttggggtaatcttacaatcggacaaagtgtttaaaatgatttgagtagagcttggggttatataaatttgttttgaactaataattgtgataataatagataaaacttaacactttactataagtaagaaggtcgattttatgcctatcaaaaagccactagcagatttgatccggcccaaaaatttatcgcaatttgtaggtcaaactaagctaatttctgaaggaaagcccctttatcaaattatcaaaaatcatgttccaatttcgctcttattatggggtccgcctggaacaggaaaaactagtctagcgcaaattatcgctcgagagtatgactatccgttagccacttttaatgcttcggttgataataaagcaaagctgatgcaaatcattaatacttatccataccaatcgtttgttctactaattgatgaaattcatcgcatgacgacaacactgcaggattatcttctgccttatttagagaacgggcaaattcttttaattggcgcaactactgaaaatccgattatgtcaattgttcctgctgtccgctcacgttgtcagatttttgaatttgagactttagatgataaggatattagtcatgttttgattcgtgctctaaaagaagtattccatttagaagaaaagcaaatagataaagaagcaattaacattattgctcgctcggctgatggagatttgcgtgtagcattaaatctattagaaactattcatgcaattaatggtgacgagatttcaattgaaagtgttaaggaatttgtaaaaggtcaacattttgcttatgacagaaaagcaactaagcattatgattatttagcagcttattcagattcaatggctgggtccgatactgatgcagccttgtattatcttaccgtcttacttaaaaacggagatctaccgtcagtagtgcggcgtctgcgagaaattccatacacatacgttggcttagccaatccagaacaagtaacgcaaatagtagttgcagctaatcaagcagaaaaaatagggatgccaaaggcaaaatatcctttgatgtttgcaactatgttaatgtgtttgtcccctaagtcaggtgcttttgatgaaatttgggaaaagcttgataaagatactactcatcctaatgagcatcccatgccacgtggattacgagatatgcattacaaacattcagaagaaataacgggtggtgggttgatagataatccatttacacaaccatttcaaattgcaaaacaaaattacatgccgaaaggtcttgaaggtaaaagatattactttgcaaaagataatgttaatgagaaaaagctagagcaacaatatttgaaacttcataaatatatttatggtaaggaatatggagagtaggtcattttaataattatgctaaaatgaaggtgaaagagaaaagaaggtaatatgatgaaaatagatgcatttgctcatattttaacgcctgatttttatcagaccatgttaaaaattgatgctacaattccacaaaaatatccttttataaagatagaaactctagttgatttaaatcaaagaatagctaattggccggataaaaatactaagcaggtaatttcatttgctaatatcaatccagaagactttgtagatggggagaaagctagtcaaattgcacaagaagcaaatcaggaactgtctgtgattgtagcttcttatcctgattattttgaagcgggagtagggatgctagcgctaaataacgttcctgcttccctcgaaatcttagaaaagattaaagctgataaaaatttagttggtgcacagatttttactcgtcatttaggtaaaagtattgctgatcctgaatttgaaccaattttattgaaagcagctgaactgcatcttcctttatggttacatcccgtttttgataatcgaaaaccagataataatctagtattttcttgggaatatgaactatcgcaggctatgttacaactggttcaaagtaatatctttaagaaagctcccaacttgaaaattttagttcaccatgcaggtgctatggttccattctttagtggtagaattaatcacattttagatccagaacatgctgagatgtttaagaatttttatgttgatacggctattttaggtaatacgccagctttgcaattaacaatagattattttggtattaatcatgtcttgtttggaactgatgctccgtttgcagttatgccagcaggagctgatgagattgtatctaatgcaattgaaaatttagatatctcggatttatatgataaaaagatctttgaaactaattattatcatatgcttgagagacaataagggagagagtgagtattatgaatgcaaatgaaaaaattatcgcactagttaagcctgaatatttaaataaaatacctaagatttttcgtaagcacgcaactgaaaatacttgtaaattaattgctaaggagcatccggatttatataaagcttttgaagaaaaagctagtgcagaagaaaaagaagaaatgaaaaaaatagtgaacggtattttcgaagaacgaatgaaaaaacataaaatgttgtaaaaaagcaatcttcagcattcatgctgttgattgctttttttgtgcataaaataatagctcatatttctattcatgcttactaagtgatacattaaaaatgaaagaatataggtagattggaggacttaatatgtataatttcgatcaagaaccagagcggcgtcacttagttgacgaatctggactaaatagctttttaagtaaaatttacggctatatggctctcgctgtttttgtatctgctctgagtgcttacttaacgatgactgtatttgctagtcaaatggtttctttaatggttcatcatccctggacgatgtggcttttattattaattccaattgttttaacatttgcaattaattttcaagctacgagaaatccagtagcaagttttattttattgatgattacagcgattgtttatggcgtaacttttgcttttattgcaggcacatatactgggcaagatattgcttctgcttttatcgcatctgcaacggtcttcgtagtcatggccattttaggtacagttactaagaaagatctaagtaggtggggctcctatgcgtcagcagcattaattggtttaattgtagcgatgttaatcaatatgtttttaaagagttcagcagctaattacatcttttcattcattgcagttattatcttcactgttttaactgcttgggatgcacaaagaatgaagaacatctatttacaatttggtggtgagcttcctactaatggattagctattgtgggagcacttcagttatatctagactttgttaacttgtttttgcagtttttaactatttttggttcaaatgataataataattaaaaatctttgtttatagtatttacgatattagcgatatattaattcatctatattttaatagactagaattatcctttgagtaggataactgaaagcttattgagagatttatcagtaaataaaagcccatgttttacacgggcttttttgttgatcgatagttgtctaattggtctgattgagctaaaaataatatgaaaagataaaaaagaatatgaaatattaattttatttattaatgcttttattattttgtgctaatattatactaaaataaattttaaggaagttgtaccaatgaatctaacatatcttaaatccaacttgttaattgtcttaaaatcaaagaaaaaccaacttcttattgttattcttgtcctattttccactttttctttatttatagtcgaaaatcaaaaaataggagatggaacaaaaagttgggaaacttatagcgaatccttgcaggcgaatgctaattattttgacagtgaaatgctaaaaaaatctacttataagaatacctatgacaatttaaataaacaagctcaggaattagctagtttacaaaatagtcaagtatttaccgatcctgtgcaatatttaaacagctatcgcaatttgctaactactatgcaagcaggctatacgaaccactatgctggagctaatacattaaatgtgccatcgcaattttttattagcaaggaattgaatcggattaattatttaattaagcataagattccgattgtaatgaataatgaaagttcagcaacatatttaatttatgttttatcatttttaggtactattatcttcttttatatttctttcatctcggctgatagctggattattaacttgaagcatcaatcagtcttaaaaaatattccttatttctttaaagacgagataattggaaagattggcattaactttatcttagttttctcatcagtattactctctataattggagcttatgtatttgctggtataaaacataattttgttactttaaactatccggttaatttttattttactcatgcacttactatacctttatggcgttattgccttgtctttttagcatatatttctggattagttatttttgttacaagtttaagtatgtttttaaatcagataactaagaacatttatttaactatcttcatcgaaggcagtatttacgctttattatttttaccaaaatatattttgaagtggcttgtatttttaccatcgccatatttagatttaaccaatctatttaatggagaccttgcaagtaatttgcatttaaccaatgttaattttctgactggctacttagtacttctgatctggtcattgattttgatttatggatttaagtatctaggggagaggaagggatgaaaatgaagaaacaatattttatttttcaactaaaatgctttttcactaatcctaaaaatattggtttatttgttttaacttttattctttctttatattttggcttagttagcgtacctaatcggcaaataattgaaaaagttgatccttatgcaattaagggagaataccaacgatataatttattcttgaaaaaagcagtaacaaaaataaatgaaatgcagaaatcaaaaaatgcacatgaggtgccgaatgaaggatatgttaatgctctaaaaacttatcctgctattctaaaatttgataaacatcgtcttcatggaattaagacaaataattggagagaatatgctatttactcaagcaggtggtataaagatgttgatcatttgatttttgtagatgagaatgaacaatttctatatcccgttcagtattaccaaaataataattatagggaggatgggcactttggttatcaaagaacagcccatttatatgacgctctagttaaaagcaaacagccacttactaggaatactatcgaggaaagaactactttacaaatattgcaaaattctatatcaggttggacagctctaatattaattattattgtgatattttttgcagcggatattgtacctaacgatcgtaagaacaaatcggtcttaaaaaatattcccttaagtaaaaattctatcctttggattaaaaccctggtagttgaaataggcgtagggataaattttttactagctttagtggtaattactttatgtacagctccaaaatacggctttggttcatttaatttgagaacgactttttatacgggaagattgtattttttacagccttttaaatatccaaccttaggagaatattttgggcagtttgggatttttgccattttaattgtttttttgtttattaggctcacgattttattttctataatttttagaaatgaatatattgctgaaatattagcaactatatttgcaattagtggaaaagttttctatttttctttaggaatgggatatgtatatccatttttacaaaatctaccaatgacatatttctctattggagaaagtttaactggaaatttagcatatttaatggattctccaggatggggatttgtagcaggactttatcctcttatttttgccattttaatagttgaaatttgtatgataatgattagtcattcaaatagagtttcattagtaaagggatgaaattaaatgcttaaattaaaaaatattaccttatcttttggtaatcatactgtcttagatgattttaattataattttcaaaatggaacaatttatggtttagttgcaccaaatggcacaggaaaatcgactttgatcaatgttatattgaacaatctgaaacctcaaaagggatacgtagaatataacgaattacagtataagaacgaaaagacaatagttaaattgcatcaagaaatttgcgcttttcctgaccaaagtgaacttttttcttttatgactgggagagatcatttaaaactttatgctaacttatggcataataatccgcagaaagtaaaagatattatttcaaccttaaaaatggaaacttatattgatcgtaaagtagaaacctattcactagggatgaaacaacgtttatgttttgcaatggtggtggctaccaatacgtcagtcatgcttttagatgaagtaatgaatggattagatccccaaaacgttcagttaatttcacaggtattgttaaatttgcgagcacaaggtaagttaataattatggcctcacatttgttgcaaaatttacagcaatatgcagatcaaattttatttttaaagaatggtagaataattaaaaatctaaacaataaagctgaaacaaaaaaatatctagaatttcatgattcaagtttgattaacgatattctcgaagaaagtaattatcaaattctacctaatcaaacgattcttttaccaattgatgaattaagtcaagataaatttgactcaataattcatatactacttgaaaataacgtttcatttactgttaggaaaatttcactagaagacttatttaacaagttttatgagtagcttagccattatttcactggcaaaatcaaagataatgaaaaataagctctattagtttatttattgcatttttagacttagaatgaaggagaatgagtagaaaagggaggacttataaatgacagaagttccaactattacattaaatgatggcaataaaatgcctttacttggtttaggcgtcttccaaataccagatcatgaaaaagcaagacaaacggttgagatggcgttagctaatggttatcggatgattgatactgcggaagtatatgaaaatcaaattgctgtaggtgaagcaattgcagagagtgcagttaatagagacgatattttcttaactacaaaaatttgggtttcaaacatgtcatttgaaaaagctactaaagcaattgatcatgacttaaaagaattaggaactgattatttagacttagtattacttcaccaaccatatggggatacattcggtgcctggaacgctttagctgctgctaagcgcgctggtaaagttcgttcaattggtttatcaaacttttatcctgatcaatacatgaacttagagcttgctcatgaagataagccagcaattaaccaaattgaaattaatccatggttccaacaaactaacgatgttaaattcttccaaggaagagatgtagtcgtagaagcttgggctcaatttgcagaaggtaaacatgatattttcaataataagacattgaaagaaattgctgatgctcaccacaagactactgctcaagttattttgcgttggcttacccaacaagatattgttgttattccaaaatctgttcatgaaaaacgtcaaaaagaaaatcttgatatttttgactttgaattaactaaagatgaaatggataagattaaaggattagataagggcgtaagtcaattctttgaccaccgtgacccagcagtaattgatgatattttcggagaaagcctaaagcaattacgtgattcagaatagtcagtaacattaagacaatagagatagatagaagcatggtttatgtttctatctatttttttattcactataatcttaatcccaaatatgatattttaaagataatcaaaaccataagaaagtaaggtgtaagaaatggaagaaaatactaaaaatatgctagcaggattaccttatcgtcccgacacagaagagttaagagctatttcgacaaaggcgcatcgcttaagccgtgactataatcaaacagcagatgaagataaggaagtaagaaaagcaattatcgataatttatttccagatcatggagaaggagtttacctgcaaggaccaattgaagtagattacggtaaatttacaaaattaggtaaaaatttttatgctaactttaatttgactattctagatacttgtccagttactattggcgacaatgtaatgtgtggtcctaatacttcattagtaacgccgctgcatcccttattgccagagcaaagaaatgcgcgcttgcaagcagatgggaagatagcagatattgaatatggcgcaccaattacaattggggataattgctggttagctagtaatgtaactgtttgtccaggagtaacgattggaaacaactgcgttattggagctggcagcgtagttacaaaagatattccagacaactctttagtttttggggttccaggccgagtagttagaaaaatcactgagaaagaccgcctagatacttatccatattaattaggtgctaaaattgcatcttgcgaacgtttgttcaaataaagtataatacttatgaaaaaagactgttgaggattttacctaaacagtcttttgttctgattatttatttttagcattcttttttagtaatccatgagactttttgtaccaataccataggccaaaaggaacgatattttcttcatggttaattaggcgcttgatattggagcggtgtcttacaaagagcaagatcatcataattcctgtaatgattgtaagaaagatatcatgaaaccagaaggaacaaatgaagatgataactattgaaaccaagcttgataaacttacatatgaagtaataaatagcattggtaaaaatactaaggcacatagtccaaagaattttaaattatagccaagaaagacaccggcgctagttgctaccgcttttccgcccttaaattttagaaagatggaaaaggtgtgacctagaatggcacaggcaccagcaattagtaataaatactttggtccctttaggtggaaaattaatggtaaatctgttgcaagtgtcccttttaatacatcaatgactaaaactgcactgcctgctacaggtcccattactctgaacgagttggttgtaccaatatttcctgatccaaaatttcttatatcttcatgaaaaaatatctttccgactaacacacctgtgggaaaggatccaatcaagtatgctaaaataaaaattagtaaataattcaacgtagacattcacttttcaaccccatttaaaatctaaagctattttaacaaagattataatagctgtggggttgattttgattgtctgttaaaaatggaggcatttatttggctaaagcaaataaaactaccagttcatatgatgattcttcgattcagattcttcatggactagaggcagtaagaaaacgtccaggaatgtatatcggttcaactgatcggcatgggttaaatcacttgatttatgaaatcgttgataactcagttgacgaagcaatggctggttatggtaaagaaatcaatgtaactattcataaagataactcagttacggttcaagattttggacgtggaatgccaacaggaatgcatgaatcaggaattccaactattgaagttatccttactgtgctacatgcaggtggtaagtttaccgaaaagaattatcaaacttctggtggtttacatggagtaggttcttctgttgtgaatgcattatcttcttatttaaaagtaagagtagtcagagacggtcaagcatatgaagaagaatttgaaaatggtggtcatccaattggtacgcttaagcatttaggtaagactaaggataaaaatggaaccactattacttttaaaccagatccaactattttttctactactacatataattacgaaaccattcaagaaagaattcgtgagtcagcgtttctattaaaaggtgttaagttcactctaactgatgaacgagaaccagaacatcatgatgaatttctgtatgaagacggaattaagtcctttgtatcttatttaaatgaagataaagacacaatgggagatgttttttacttctctggtaagcaaaatgggattgaagttgaattttcaggtcaatacaatgatggatattccgaaaactttgtttcatttgtaaataatgttcgtaccgctgatggtggtagtcatgaagctggagcacgcagtggatttacaaaggcttttaatgattatgctaaaaaacaaggtctattaaagaataaggataagggtctagaaggtagcgattaccgggaaggcttaagtgcagtattatctgttaagattccagaagaattactagaatttgaaggacaaactaaaggtaaactaggaactcctcaagctagaagtgttgtagacagtattgtttatgaacagctttcatactatttaatggaaaacggagaatttgctcaaagcttagttcagaaagcacaaaaagcaagggatgcacgtgaagctgctaaaaaggccagagatgaaagcagaagtggtaaaaagagacgaaagaaggagattctttcaggaaaattaactcctgctcaatcacgtaatccaaagaaaaatgagttattcctagtcgaaggggactcagccggtggttccgcaaaacaaggaagagatagaaagttccaagctattttgccattacgaggcaaggtcttaaatacgcaaaaagctaagttacaagatatctttaaaaatgaagaaatcaacaccatgatccatacgattggtgcaggtgttgggtcagattttcagattaaggatgcaaattacgataaaatcatcatcatgacagatgcggatactgatggtgcccatattcaaattttgcttttaactttcttttacagatatatgcgtccaatggttgaagcgggtcgtgtgtatattgctctgcctcctttatacaaattacaaaaaggtaacggagcaaaagccaagattaaatatgcttggactgatgaagaattgagcgaagactctaaagacatgggtaagggttttgctttgcagcgtttcaaaggtttaggggaaatgaatgctgatcaattatgggaaacaactatgaatcctgaaactcgtaccttaattagagttaagattgacgatgctcaacttgctgaaaagcgtgtaacaaccttaatgggagataaagtggctcctagaagaaaatggattgatgaaaacgttaaattccgtatgggtgaagacggatcaattctagaaacaagtagagattaagaggttatatttttaaatgacacaaacaaatgaaagaattagggaattacctcttgaagaagttatgggtgaaagatttggacgatattcaaaatatattatccaagaacgtgctctcccagatattcgagatggcttaaaaccagttcaacgtcgtattctttatgcgatgtataaagataataatacatatgataagccttataagaaggcggcaaaagctgtcggtaatgtcatgggtaactttcaccctcatggtgacagttctatttatggggctttggttcacttatcgcaagattggaaaatgcgtgaacctttaatcgaaatgcacggtaataatggatcgatggatggggatggtccagcagccatgcgttataccgaatctcgtttaagtaaaatttctaatttacttttacaagatattgataaagaaactgttcaaatgattttgaactttgatgatacagagtatgaaccaacagttttaccggcccactttcctaacttattagttaatggatcaacaggtatctcagctggatacgcaactgaaattccacctcataatcttgctgaggttattgaagcagctgtttatctgctaaagcatcccgatgctacaacagatgatttgatgaaatttgttaagggacctgattttccaacaggtggcattgtcctaggaactaagggcattaaagaggcctatgaaactggtcgtggaagaattcaagttaggtctaagactacaattcaagaaattaaaggccatcgtcagcaaatagttgtaaccgaagtacctttcggcgtaaataaagcaatgatggttaagaaaattgacgaaatccgtttaaataaggaaattgacggtatttcagaagtaagagatgaaactgatcgtcatggcctttcaattgtaatcgaacttaaaaagggtgctgatagtcaaaacatcttgaactatctatttaaaaacactgacttacaagtttcatacaatttcaatatggttgctattgatcgtatgactcccgtacaagttggattaaagcgtattttatcttcttatttagcacataaaaaagatgttgtaactaagagaacagaatttgatctaaagaaagctaaacagcgtctagaaatagttgaaggtcttattcatgccttagatattttagatcaagtaatcaagactattagatcttctaaagataaaaaagatgctaaaaagaatttaattgctaagtatgacttcactcctaatcaagcggaagctatagtttctttgcagttataccgtttaactaatactgatgttaaccaacttaaaaaggaacaagcagatttaaataaaaaaatcgaaaagttcaatgaaatattaagtgataataaggttcttgaaagagttgtagttaaagaattaaatgcggtaaaaagagaattcggttcaccaagaagaacagaaattactgctaaagcagctaaaattgaaattaatgaaaaagctctagtagctgatgaagatgtacgagtattagtaagtaaagacggctacttgaagcgttcatctcttcgttcattccaatcaaccgatgatgaagataatggattacctgctggtgataaggttgtgtttgaaaagacaatgtctaccttggataacctttatatttttactaataaaggaaatctaatttatcgtccggtacatgaattaattgaaacgaaatggaaagaaacggggcagcacctgtctcaagaaattggtcttgatagtgatgaagaaattattcgggtgtttgaagttaatgatttaaaggccaatttaaactttttgattgctaccaacgatggatacattaaacaagttacattagcagatttacaacctactagaacatataagtctcgtgcaattactgctattaagcttaagagtaatgacagtaaagttgtccgcattgatcaagttcaacctgatagtaagcaagaaataactctaattactaaccaagcatatgcagtaagatttgatattagtgagatacctacatccggctcaaaagcagttggtgttaaatccgttaaccttaaagatgatgactacatagtaaattatgttttagctgatcctaaatatattgatttaattaagattggaatcatcactcaacggggagcgtttaagcaactaaaacttagccttataaataaagttacgcgtgcaaaacgaggtgtccttgtactacgtgaacttaagactaagcctcatcgaattatggcaatcagtagttatggtgaaaatcatattctccatctgaatacttctagtgatcgtcatattgaacttaacacttctgaattcccattgggcgaccgctattcaaatggatcttttgtactagacccaatgacagatgggactcctgtctcgttaacgcttggccgaccaattgcagatggaagagataaaactgaagatttattttaattagttaaaaactaaggataatgattgaactgttatccttagtttttttattaaaataagaattataggaaaatagtatgcattttatgcaaaattttttattattattggcacaggtgttattataaaaagtgtgagatgaatattaagctttaataaaggactatcagaaaataattagttgtatttaaaaatcttattcattagctattattccagatttatataagaggtattcaattatgaaaacaaatactgatgcggttttatccgcgaaatcgttacgttactttcttcaattaattgataatatgagttatacgcaagcagctcaaattttaggtattactcagccggccttaacgcaacaaattaaaaagcttgaacgagcagttgggtcaccattatttggccaaatgggcaaaaaattatatttaactgatgctggcctaaagatggaagagacagcaaaagcactattttcaacagttaataatgctgtagacagtattcagcaatacactaaatcagataccggaactatttctttaggaatattatctactattgaagcaagagtaattgatcaattcttagttaaattcaaccataaatatcctgatataacattacatgtgggtttctataataggacagaactttgggatagactagataataatcaattagatttagcagttctttacatgccagatcataattcaactgtgaagaacatgaaacagtatatggcaaaacaaatttatcctgaagaagttattttcttaactcacgatccagaagatgagtttaataaaacaactcggcataaatgggttgcttatcctaaggactactacttaccacaaattgttcgtcgcttttatgctagtgagtttccaaacaatgaattaaatactacggtaacatttactgctccatatcaattaatcaaatttgctgagcaaaccgactataacacttatgtctccaagagtttttataaggcacacaaagctgaaattacattatctccagtaaagacaaaaagtgagacaaactttgagagttgttttatttatcgtaaaaataagagtgaaatacctcgactagtcaacttcttaaaagagtgggataagtttattgaagaaaaagattatgatagtagactagaggatattaaagttaatatttagttttaaggcattctttttatagcaaaaggatgcctttttgatgcgtgatagatttgcttaagtttaacttttaatctaaaataattaggtagatataattttaaaggagctctatataatggcaaaagaattgatttttggtcaccaaaatcctgatacagatgcaatcggaacagcaattgcatactcatacttacaaaataagttaggttacgacaccgaagctgttgctttaggtgaagctaatgatgaaactaagtatgctttaaataagtttggttttactgcacctcgtgttattaaaactgcttcaaatgaagttgatgcagtaatgcttgttgaccataacgaacctcaacagagtgtttctgacattgataaggttaaagtaactcatgtagttgatcaccaccgtattatgaacttcaatactgctgatcctttatactaccgtgcagctccagttggttgtaccagtaccattatgtggcaaatgtacaacgaaaaagaaattgaaattccacaagatattgcaggaattatgctttcagctattatctcagatactttactcttaaagtcaccaacaactactgaccaagataaagaagctgtagtatctttagcaaacattgctggtgttgactacaaagaatacggtcttaagatgcttaaagctggtactaatattgctgacaagtcagaagaagacctaattgatttagatgctaagagttttgaattaaacggtagcaacgttcgtgtagcacaaattaacgttgttgatttaccagaagccttagaacgtaaagacgctttcttaaaggctatggatgaagcttctaagcgtgaaggttacgatatgtttatgcttttaattaccaacatccttgactcagattcagaagctttagtagtaggtagtgatgaatcaaaagctaaatttgaaaaagcatttaacgctaaattatcagattcagaagttaaattaccaggcgttgtttcaagaaagaaacaagttgttcctccattaactaacgcttttgaagcttaattatttggtttaatttagaaaaagacaggtatgatcctttcatacttgtttttttatttagtagaggaaaatgaaatcatcaatagaagtactaaagaatgtttttggttatacaacttttcgtcctggacaagaacgagttattgagcaagttcttaaaggaagaaatgttttagctgtaatgccaactggagcaggaaagtcaatgtgttatcagataccagcattggttaaccctggtgtaacgttggtaatatctcctttaatttccttaatgaaggatcagatagactctctaaaacaaaatggcattaatgctgctgctttaaattcagcaactcctcaagaagaagtaaatccaatcttgagacaagcctatgaaggaaaaataaaacttttatacataactcctgagcgactagcaatggattattttcgctatcaattaaactttttggatatttctttagttgcagtagatgaagcccattgtatttctcaatggggccatgactttagacctgcgtatcgccaaattatggagggagtaaagtcaattaaaagccagcctaatattttagctttaacagcaactgcaacaccttcagttcagaaagatattgcagatcaattaaatattccggctgaaaattatgttattacttcatttgcaagaccaaatttgagcttcaaggtagtagataatcctaaaaatactaacttatatcttttagattatattaaaaagcatcccaatcaatcggggattgtgtatgcgagtacaagaaaaaatgttgaagagttgactgactatttagctcaaaatggaattttaacagcgagttatcatgctgggctatctaataaagaaagagccgatgtacaagatgcctttcaatttgataaggtccaagtgattgttgcaacaaatgcttttggtatgggaattgataaaagaaatgttcgatttgtaattcacgctaatagtactccaaacttagaatcatattatcaagaagccgggagagcaggcagagacggagagccatgtgaaggaatattaatttatcacccgaaagatattagactatatcgttggtttattgaacaatctgatttagatgatgaataccaaaaaattcaatatcagaaattagctgcaattactaagtacgtcaatacaacggaatgtttacaacaatttatcgtcagatattttggtcagacttgctctccatgtggcaaatgttctaattgtttgggaacatttattgaaaaagatattactgcagaaagcaaaaaaatcatttcaacaatttatgaacttgatggacgttttggcaaaaatgtagttgccgatgtagttacaggtgccaataatcagcgcatgcgagaaattcgggcatctaattttaaaaattatggtagtttgaagttaggaaagagagctgctttagatttaattaattatctactcagccataactacttggagttaacagatactcaatatcctgtagttcatgtaactaatttaggatgggacgttttagatgataaaaagcaagtaagtcaaaagatttcaaaaaatatcaggaaatcaatacaacttactaatcaaatttcagaaaaggaaaataacctattcttgcgtttaaaggaaacacgcttagaattagctaaagagcaggggataccggcattttatattttttcagataaatcattaagagatatggcacttcaaaaacctaaaacaaaaacagactttttgaatatttcaggtgttggtcaagcaaaactaaaagcatatgggcaaattatgcttgataccattagaaaatatttgaaagaagaaatagattaatgaagtgtctagtaataaatagtagaatagactagaacagattaaaaataggaggactaaaatggaatatccacaattagaccttgaaaatgtaaaaggtccaaaagcagtaattaaaactaatcatggagatattaaagttcaattatttgaaaaagatgctccaatgactgtagaaaattttgttcgtttagctaaaaagggttactatgataatactacttttcatcgtgtaattagtgactttatgatccaaggtggtgatccaaagggtgacggtactggcggtgagagtatctggggacatccttttgaagatgagttttcaaataaactctttaacttacgtggtgcactttccatggctaattctggtcctaatactaatggtagtcaattctttattgttcaaaataagaatgtgcctaaacgaatgattaaggaaatggatgcagctggctatccaaaagaaattgtaaaagcatataaacagggtggaaccccatggttagatggtcgtcatacagtttttggtcaagtaattgatggtatggatgtcgttgatgaaattgcaaaggttccacgtgataaggcaaatgataagcctaaagaagatgtaattattaagaacattcagattgaagattaattcggttaaaaacatggtctaccttgatcatgtttttaatttgggcttataacacgggggttaaatatgaatatatttactaatgataagtatcggccatcagaatcacgtattttagctacatccttaactttttcagctggttttattgatgcttatacttatattcaacgaggacatactttatctgcagggcaaacaggaaatgttatcttctttgcttcagcatttgcggatcacaatatagctggtatgttaaatagagcaactacatttattgcatttactttagggttattactggtaggtctttttcataaatacgtaaaaagtaattattggcgggtattttgtctatttccaattttacttatttgcttaggagtaggctttgttcctaaaactgttccgaattattatgtcgtgcccgtaattgcctttggactggctgttcaaaatgcttcctttagtaagatcgaaggtatggggtataataatgcatttacaactggtaatttaaaaaaatctgtcgttgcctggagtgcatatttctttggtgaagataaatctcagcataatgcagctgttaactacatgcttttagttattgcttttgcatttggagccattgtgtcagcattacttcaaaaagtatttctcttaaaaactatatggtttgcagtattacttctgggaactattaatattgtttatacaatttcattaagtaaacggaaaaaattaaatttcaaaaatgagtagtcgttaaaatttttagtacatgttttaaaatctcactaaatgaactgtgtattcagtggttcaatttggtgagatttttatttagaaaaaataagtggtaaagagaaaaggagctaataaatcataaaagcataaattcgtataatatatattatgtaaagtagtatataaaaattatagaatatatcaaaagtaccttgtttatatgtattatgttttaggcagttaaatctttatcaacatatctaaaataatttttctgggttaattagattcttactaactaaaaaatataagttaaggatttttattttgaatcttcactgtaagcttaagtaaaaatttttatagctatgtctatctcttatctataactttgtgatgctgtggcggccattctatggcttttaaaataattattggttagcagttaatcgatttgatttaaattttctgttatatgtcctatgcaaaatgtttgctattgccagagcttatttgtggatttaagctagttgtacaagtattctcagataaaagcttagataggataagtatattttatcttgaacttatgatattttgaaaataattgaaatataagggattgctagattttatagttcttactgaatatgattatggtaatacatagagtaataaattaggacaatattactcctggctggggcaataatacatgatttttcattaaaattacctttcattaaaattattgttttaatgaaaggtatagatgtatatcctataaaatatggatttttaattcattcaaatcgatctgttttttcttttaaagttaacttttaaaattttgttttgatcccaacagctacaaatttattttaaccatatgtaattcagtccgatatttaaatattttactatatcatttttgaactaatactttttattctcctttaatactcttattcagcttatgtttatctcctattttaaccttaacttctcatacattatagttaattttattattcatgctttgaaactacgcttatttacagcaataattgctttttacttaatgatttttcttaaataccctttatttatactaaaaatccgttctttttagattaatttattgttctgatcctgttagttgtaaattgatctaaattccatacgcgttataactaattaccagccttttccatagtatactagcttgtctcccctctctcctgctaggggacagtaacaaaactttttttaggtcaataaataagatataatattatacaaacctacgttcgaggagactataatttggaaactaataaatacttagaacttattaagcaagaattggctaatatgccagattttgtaaaggaatacaatctaggaacttctcattcattaactacaacctatcaatatttaactgaaattcgacgttttttcgactggctaagacaaaataatattgcttcagtttcttctaataaagagattgaagtaacgacgttggaaaatctacaaagaaatgatgttatgctgtacattcatcatcttaaacatactaaaaatcaacaaggtcgcttaaattcgccaactaccattaatcgttctattaatgctctacgctccctctataagttcttaacgattacttctgacaataatcatggtgaaccatattttgaccgtaatgtcatgttaaaaatcaattcattaaatgacactaagacattaaattatagagctcatgttttagagtcacatatgtatatgggagatttaaagtaccaattcttagattttattgaaaatgaatatatacataaatgtaataagcagtccctacctgcctttaaaaagaatcacgagcgagatatggcgattattgcattgattttaggaactggaattagagtttctgaatgtgttggcgtaaatatgcgtaatattaatttaaaagatgctatgctggatgttacacgcaaaggtggtcaaaaagatagtgttcccattgctgaatggacgattccttatttaaagaaatatagggaaatacgtgccgatcattatcatgctgaaaaagaagatattgctttctttttaactagatggcatggaaagactaaaaggataaccactaatgcagttgagaaaatggttaacaagtattctgcagcttttgggaaacctcttactccccataagttacgccatacgctagctagtgaactttatgaagtaactaaggatcaagtgttagtagcacagcaattgggtcagaaaggaacaacagctactgatttatatactcatgtagatcaaaaaaaacaaaaagcggcactaaataaaataaatagatataaatcttctgattaattcaactctaatctcattatttagcctataataaaagtgtatactttatgtaaaaaggaaggaacacttcatggaattaagagttttaagatattttcttgcggtttgtgaagcaaaaaatatatcaaaggcagctgaagctcttcatattagtcaaccatcgctttcacgccaattgaaaaatttagaggctgaacttggcgtaactttgttttatcgtggacatcaggaaattactcttactcaagaaggatattatcttcaggaacatgcagaagaaataatttctttgaccaataaaacacaacaaaatctaaaacgctctcaaattatatctggtgaattatacatcggagcaggagaaagtattgcaactaaacgtgtaatggatattatccatcaaattttacagaactatcctcaagtgaagattcacttctttaatggaaattcatccatgattgaaagcaagcttgagcgcggactattagactttggaattacaatgggccaatatgatactactcaaaattttaatagtctgacccttcctgaaattaatgaatatggtgtgattgtaagtaaaaatcacccattagctgatcattcctgtgttactgccgaagatttacaaaattatcctgtcattatgtcaaaacatacggctgattctgataactttagagattggtatactgagccacaaaagttaaatatcgtggctacatttaacttacctgataatttgcagtatctcgtagacaagggaccttattgcctattgatatataaagatttgcttcctttagataagagtaatttatgctttttaccacttgagcctaaaattattgaccataatcgtttgatttggagttcaagaaatcaactatcaaatgttgcaagtctatttcttaaactgatacgagattctataaaaagcaaaaattaatttatacataaaaaacgatttgaagatctaaaaaagattttcaaatcgttttttaattaatgactttgctgactagcagcagattgttggttgttttgtgctcgtccttgattattgtggttagtatctgagctgttgttactattattggcttgtgattgttgactagattctttattatcagaggattgggttgatgtactactttgactttgagaatgttgactttcctcgttatgttcttctgatttgctactttgcgatgaactagattgttggctactacttgaagaactttcacttgattgactagattgagtatttgaatttccagaatcaatatcaatatcaaaactatcatcagcttttggatggtatactctatgactcttctttgtggctgtcttagctctcaatgcttttggagtacttaccttaattgcattgatttctgtatatgtcccctcttgagaaatatcgtatccagcataagcaaaacgcaagtagaatgaaaagctcgtcaagactaagtggccgcccttttcttttaaggtatattcaacctttaaccttttaagtgctccctcattatctaatccagatgcattacctttaagctttttaattagcttactgtgggtcttattccagaactttagactattaccactgtagctaacgcgatagatagagccagatttcttaagtttcatatcacctttaattgctttacttccgcttaaaataattgctgggtcgaattggctaactactttattaggagtcatagtagaagaagctttccactttggactaccagtattatcccacattttttgatatactttgtcttcatttagccacatagatgtcttatcaactttagcttgtgccttaagtggatcattttgatattccccagtccaagttcttgtagcttgaattccgggtgaattctttacattaaatttatagcttttgaaatcggtattgagtgcttctgcaataatttctttgtcactactattacttgtagcagaattaacagcggtaggactactacttttaatagcacttgtgttcatagctaatataacttgaaaaacgattaccagtcctagaccaataccagcgactagtcctaatatttttaaaaacttatttttcatttaatcactctcgttttaagttcatgtaatttactttattaaaaaaataggaaagcaactttagctctcctatttttgatatgattattttttactaaagtccattttatctatgtctgccatccaagtaataccaagagatttttctcctaaataggtagcaattacggaactaaaattgaacattttaatggtcatattagggaaagcagcttgaaaatcatttttaaccttagtagcctgctctaaatcattagaattataaactgctaatgacaatttatccttaataggcgaattattaattcgctcaatagtgatattttcagccttcttaacagctctcttcatggaacgaactttatcaaaacttacgatttgataatcatcctttttaaatgttaaaagtggcttaatttgaagcatggtaccaataaaagcactcgcattactcaaacggccgccgcgcactaagttatttaaatcatctacaacgaaaagaacatcaattgtatctctaatttcgtctaacttagatagaatttctttaggttcccaaccatttttaatcattttagcagctgctagcactagatttcccattgaacgaacggtcattgctggatcataaggataaagattaaattcaggatgattatgagctaaagtaactaaactgttataaaagccagaaataccagatgttaagggaatagcaataatagcttcataaccttcatttttcaatttttggcataattcaagcatagtacccggactaggctgcgaagtcttaggaaaaggtgctccatcgcgttctagctcaaaaagcttctctgcagtaatatctaccccatccatgtattgcttatctccaataataaccggaataggtactactgtaatatcattggccttggcttcttctgggcttatatcactagtactatctgtaatgagtgctatcttcacgtgtgaaaacctaccttaaaattaaaatggcagcattaagttgcatgctgcaatactacttatcaaaatgaaattatatcataaaatccaacgttttttaaacataatcgatgatttatacttcatctgttacaaggttattaacaataatttgtaatttactatcaaaatcctgtattttttcttcactccaactagaaaaaatttgtgcttcaatttgagaaagaactttttttaattcttgggctttagctaatccttcattgtttaaatttaaagatttgctagaatccttctttgaacgttctactttaattaaagaagcagtttttttctgcttgatttgtctacttagggtcgaaagagatatacttaatgcctgtgctaattctcccatcgtcaaagtctcgttctgatgatgatcaaagaatagtaataagcgagtttgagagaggtttaatccacactttttattaatcactcgcttaatattctcactaacgctattaaatattaagacattcattttatttaccacctatacttaattttcccatttttctaatcaacaataattctaagacataatttaatttttcacaagattcgtgaaaaattaacaatattagtgaaaaaatcacatatatatttatcaaggaaattcaagagattaaagagtataattaaatatactgttttaaaggaggatatttatggcttttgatggtttatttattcatagtcttctgcaagatctctcccctactctggttggaggaaaacttactaaaatataccaaccatttgaacaagatttagttttaaatttcaggaaagatcgtaagaatcagcgtttgctgatttctgctaatgctcaaaatccacgcttttatattacaaatgatacaattgcaaatcctgacgttgctcctacttttgttatggttttgcggaaatatttagaaggatcagttcttcaaaaaatcgaacaaatcggtgttgagagaatagttaactttcatttttctaatcgaaatgaattaggagatgaaatgcagcttattttatcggtagaattgatgggacgacatagtaatgtgattttatataatgcggataataataaaattattgatttgcttaaaagaatcaatcctgatgaaaaccgcgcacgcttattacttccacatgcaccttatgaactgcctcctcttcttccaggaatcaaatggctttgatctttgtgctgacaacttcaatgacttaaaggaaaagtatcctgaaccagcagattttgtaagacaatttaatggtttagacggagacgataaaaaagaatttactggttacttagaagacgatttttcatatagttctttacagacattttttaatcaatttaataggccaaaaggatatgtgctacagaccattaagcataaggatcgtgtatatacttacctaccatatcatctagaattaaatttgatttattctaatgacgatgtcaataaaacattagacgagttttatcgtgatcaggctaatcgtgaatgggtaaagcaaaaatctaaaagaattgaaaatattgttaataatgagcttaaaaaacttaaaaagaagattattaagttacgtaagcaattagatcaagccgagaattctgaagaatatcgaattaagggtgaattacttaatgcttatcttcatgaagtaaaggctgggatgacaagtattgatctaccaaattattatgaaaataataagcccttaaaaataaaacttgatcccgcactttcacctgctagaaatgcccaaaaatactttactcgttatcaaaaattacgtaattcaattaaacatgttaatgaacaaattaaattagcaaatgagaacttagattactttgattctatccaaactgcaattgataatgcggatccacaagatattgatgcaattagcgatgaattaattaatcaaggctatctaaaagagcaaaatcataatcgtcatcggaagaaaaagattagtgaaaaaaatttgaatacttttaaactaagtgatggtaaaaaagtattagttggtaaaaataattatcaaaatgattggctaactttaaagaaggcggataaacgtgattactggttccacgttaaaaatatgcccggttctcatgtcattttacaagatagtgccccaagtgatgaagatatcaaagaagcagctgaaattgctgcctatttctctaaaggaaagaattctagtcacgtcccagttgattatgtgcaagttaaaagaattaaaaagcctaatggagctaagccaggttttgtcatttatactggtcagaattcaatcgaagtcactcccaatgaaaaagatattttagaaaaaagaatatagaaaaaagcgttcatatcaaaatgagcgctttttctatagtctctaaatttacataataaataatatttaattttacaaaggctgagtagtcattgctaaagtttcaagtactattaaaacatcttgcgctgattgtaaactagaaaaaacaggaatatgtgtgcttaaagctgcatctttaatcataattgcatcatgactagcagagtcggataaactggttacattgattactagattaattcgatgctgctttatcttttcaagtaagctattgcttccctcttgaaccttttcaataattcctgttgttattccctcttcagctaatacatttgcagtaccttcagttgctaaaagcttaaaacctaactgatgaaaacgtgcagctattttaattgcattatgtttttcagaatctttaaccgaaataaagacagtaccatatgttgaaatcattaaatcactgccttcatatcctttaaacaaggcagtcggcaaatgcttggctcgtcccatcacactaccagaggtcttcatcttagaatcaaaggtattttcactactatatgataaataagaaaagacgggcattttaacgtgaattaagtcgtttgatggccaaatatcgcttggaagatctaattcagacaatgtacttcctaacaaaactttcattgttatagctgtaatatctttttttagtgctttagttagaaaagctacattgtgtccagagtaacttttaatttgtaataaatagatttgatcattagctagtaaaaagtgtaagttaactggtcctcttaaattaagtttagtggcaatactaattgcactatcacgtaatctacgctgatcattagttgataaattttgtggacgatagacagctatggagtcactggcatgtgagccggtctgttcaaagtgttcaataattccgggaatagtaacatttttaccatcagaaatagcagtcacttcatactttttaccttcaataaacttcgaaacattcatatgctctaatgaattttcagcaatatatctttgtaaagctggtaaatcaaagaccacagcagatttttgcttcttaccgttacttgtaccaccaattaaagctggaaaaccatttcttttaacaaaagctaaaatgctttcttcattgtcgcattgaagagctgggactggattaacgccggcctgatatacttcgtctgcatgatcttcccttagaatttccttcaaattaggctgacctaaaattgttagcccatgttctaagagtgaactgcgatattcattaatctgtttgccagaaaattgcgttaccacttctttgatattttctttccatgcaacttcaagaatattttctaaagtaattggttcaaagtaaattcgatcgcatacatcatacgctgcactcacactttctggattattactaataatcacaggactaattccttgctcttttaaggtcttggcagcatggtagagcatataatcaaattctccagttagagatacttgaaatggttttaatcctaaaagaaggcattttttcgaattagatagtggtattatttcatcttcaattccataactactgtaaacagcttgaatattaggatgaattaatccagctgttccatcaatttcaatatagctaggcttaattgaccattttttacataaatcagcaattgatttttcatctcgctgcgtaatttcagcaattaatcgattagaaaaaccatttttctttactttcagcattaaatcagctgtaagttcatcattacgtaatttctttaataaaatcaaaatatgattaaacttctgcaaaaatactaaatgaatatgtaaaagctggtgaagagtgtggtaattaattccctttgctatcgcggctaatagtgtaattaggtgtatttcattaggcttcgatagatcttgcaataattctttttcgctttttttatattcctttttaaaggtcttaacattattagaaaaaccagtagttgactggagagcctttaaaaatgcactttcaaagttacgaccaattcctagagcttggcctccggaagtggttttattattaagagtgtagtgattataaccagcttctgtgaaagaccaataaggtaattttacaaagcaagcatcttgcacgggatcaacagcagcagaaattccagattgtggatcggtaatttcatttaaattatagccaagtgcaattttggccgttacatatccaatagaatatacgccacttctataagaaagcaaactactctgagtcaaacggggcttaatacttaatactttaaaattaaagtcttccccactttgcttaacagcaaaatgaatactcaaagctccatgtaaattaagacaattagcaatctttcgacagcaatttcttaagcgctgaatttgattattatttctagttaaaattggcgtcactaataaagaatccgaagagttaataccaactggttctaaactgccaatatttcctacaaatacaaagtttccattattatcccgaacaatatcaaaaattaattcttcccaattcgataaatcttcagttaaacgataatctttccaattaaaatggtcatcggattcttcatctaagaagtattgttctaattgagctagattttctagagagatcatgctatcggggcgataatgctgcttttttgataaaagcaaaggaaaatgagcatgttcaattactcgccttaagtcctcttctttttctaacagccattgattggccaccgcaatcttatttgctttaagaaaactatagaaattatgaggagctgatagactcaatgccaagctgttaatagttagtaactcaatattcatttgggttaagatgcccgactctaataattcactggtaagttttaaagccggtttgcccccaaaagccggaataatagcatctggcttctccatccgaacgattcgcttcacaaaaggcaacgtcattggttcaagatatacatttacattaggatgcggatctgttgtgacggttgcaggattgggattaatcaatacaacttgtacgttactttcttcaaaagccgttaacgcttgtttagcaagaatatcaagttctgttacttctccaacaatacttggccccgctccaataacaagaactttattaatttcattatgtaaaggcatagtctactccatcatattcaaaaactgatcataaatgctggctgcatcaaaattacctggtgagccttctggattaaaggcagttgctaaaactttatcttttttgatactgtagcctgctaataactccgatcttaaatcaaaatatttacgtgaaagattcaaagataaactatcaggtactactagttgatcaatattcattgcagtttgccaaattcgattattagtttgttcaataactggaaaattactaccattataggctggaattaagtccaagagttctaggtctaaataattactaattgctaaaaagcctaagccaattcctaaaataggtaatttcccgtaaaacttatcaaatactggttttaaaaatggtgcaacttcttctactccacttggtccattagaaataacaattgcatcagctcgaagattaataatgtcgtaaattgatgcattgtatggtaaaaccacgctattaatttcccgtaaagaaagggatcgcagtagtgaatgctttaaaccaagatcaattacagccacagttttgccaatatttggggcagcataaggatgcgttgtagatatttgtgccgttttattttttggtaaaactagggccttgatttgatcgaaagcatgtgcatcatctgtatccataatagacgctttaataactcgcttattcttcaatttttgaactagagcgcgggtatcaacaccgtagattgctggaattcttttctcttttagaaaatcatttaaatcttgaaaagttggattagcagaaatatgaaaagcaatatcgttagcaattattccacgtacactcggatcaattgattcatagtcgattgcattaataccacttccaccaatcattggagtagtaaaagccaaaatcttaccaaagttggcagggtcggaaattgcttcctgatatccaaaattgcttgtttgaataccgagctcccctgtagcagtaatgggagcaccaaaaccgtgtcccgaaaatgcagttccgtcttcaagaattaaatatcttttcataatctattgcttcatttcttgtcgtaaattctttaattgtttttcaaaaattgttggcaatggtgcagaaaattccaaccattcattcgtagaaggttgataaaatcccaaagtcttggcatgcaaaaattgtccatgacctgacaaggttttctttgggccatataagggatcgccagctaatggatgaccgatgtacttcatatgcactctaatttgatgcgttctacccgtttccagtacacatttgactaaactataatttttaaattgctctagtactgtaaagtgtgtaactgcagctttcccctttggattaaccgccatttgctttcgattatttggatttctaccaatcggagcattgattacgccattttttacttcaaagttgccatgaacaattgccaaatattctcttttatttatcttttctgctaattgcttttctaagctttcacgtgctttatcatttttagctatcattaataaaccagaggtatctttatcaattcgatgcacaatccctggacgaaacccttcaggactatcagctaaatcacgtgtatgataaagtaatccgttgactaaagtatgatctggatgaccggctgagggatgaacaaccatcccttgaggcttattaaccacaatcacatccgagtcttcataaacaatatcaagatgtaagttttcagcttctaatgataatggtttaacaggcggaatagtaacatcaattacatccccagactgtactttataagatactttttcagctttattattaactaaaatatttttatcattaactaattccttaatcttagttcgacttaaatctgtaattttctcagcgattaccttatctaaacgtcctttttcgtcatcaattactaatttataatttttagtcatttactcttcgtcctttagtctttttcgcttataaatattagatagataaaaactaagataattccaactgtaattgcgctgtccgcaatattaaagatattaaattgaataaaatctagttgcaacatatcaattacatattttagatgcaaacgatcaataaagttaccaatgattccacctaaaactaaggctaatcctgtatcaaaaaggccatttttatatttgggattaaaaagatagtaaattacaactgcaatagcggcaatactgattaaataaaataaaatcatttgtccactgaagatattccaagctgctccatcgttttgtaaatatgtaaatgaaaggacaccaggaataatggtcttttcatcaccaattttaaaattagtaactatataattctttaataattgatctgcaatgattactaataaagaaactattagatataaggcttgtttagctttactcattagaataatcctgaaatctttccgttattatctacatcaatatctaaggcagctggatattttggcaatcctggcatatctaaaatagatcccgtagctaccacaataaaacctgctccatttttaagagctaaattcttaacatggagtgtaaaatcttttggagctcctaagatactctttttatcagtaaagctatactgtgttttagccataattactggtaagttgtctttacccattttcttaatttctgctaattggtccttagctttatcagaatattcaatatccttggcatgataaatattatgagcgattttactaattttttcttctacagagtcagtaggttcatatactgaggtaaagtcactagctttattagttaactcaaccactttttctgccgccttaattccgccctttgatccttcatcatggtaagagaccacttcacattcaaaaccatcagctttaacaagttctttcaattttgatagttcttgttcagtatcactagcaaatttatttattagtacaattacaggtacaccataatgagccatgttttccatatggcgctttaagttctcaaaacctttttctaaagctggaatattttcttcatctaagtgatcagttgtctcttctgcttgatacttcaacgctcttacggttgcaacaactaccacagcatcaggacgtttgtccaaatggttagaaacaaagtccataaacttttggccacccagatctgccccaaaaccagcttcagtcaaaacatagtcgcttaagtgtaaagcagtattagtagcaattactgaattagcaccatgagcaatgttagcaaatggaccgccgtgaacaattgctggggtatgttcaagtgtttgaactaagttaggctttaatgcggttgataaaagcgcagcaattgccccctcaaaccctaagtctttaacataaacaggttcatctttcacagaaaagccaactagcatatttccaatgcgctttttcaagtcatcaatatcagttgctaaacataaaatagccattaattcattagctacagtaattgcaaagctagcttcatgttctattccattaaaacgtgaaccttgtccgatagtgatttttcttaaagtacgatcattaacgtcaattccacgttttaataagatacgattaggatctagctctagactattatcttgataaatatagttatcaactaaagcagccaaagtatcaattgcactagttaatgcgtgcatatcaccagtaaagtgtaaattaatatcttccattgtgatgatctgtgcatatccaccaccagttgcaccaccttttaatccaaaaacaggacccattgagggttctcttaatgcaattaaagtatttttgtgaagttggttgctgattgcatcccctaaaccaatggtaatagtagattttccttcaccagctggcgtaggactaattgaagtaacaagaattagcttaccaagctttttaccttgtttaattctgttaattcccttccagctaatcttagccttatcattaccataaagttcaatttcatctggttgaagatcaactttttttgcaatttctgtaataggtaattctttagtgtcttgtgcgatttcaatatctgacttcaaattcattccttctttcttttaagtgctaaaagcaagtaagtattaatcttactctttgcttcatatacaacaaatgccttccattgccacttaatctttaaattttgaagctgaagtttctgacgatatggtagttttagccagtaaacacttgcttctttctgaaaataagaattaaaccaggtataaataactataaccacaaaaatagctcctaagctaagtgcaggatagctaattgctttattgctttcatacccgacaataaaggctacaaaaattagtgctaggagccaggagtaataaattacaccagcagcgcctaaaaaaataaaatgttttttcataatttagaatttaggtcacaccctatttgttaattacctctattgtaacaaaaatcaagtagatttacgtttttgtttaaaatagcgttctagactataatattagacaagaatatggaggaaaataacaacatgaaaatcggcgttttaactgacagttcatcttatttaactaaagaacaatgcgagaaatatggaattgatgtcttaccaattccaatcatctgggataataaagaatatctggatttaattgatattggtttccatgaattctatgaaaagctaagcacttcttctactcttcccactacctctcaaccctcaactggaaccgtaaaaaaatatgttgataaatatattgatgaaggttataccgatctaattatcattactctttcaagcggtatttctagcttttacaataatgttttaagtgtggctgatgaagaaagcagaattaatattcatccctttgattgtaaaataacctgtgcaggagaagctaatgctgcaatattagctggtcgactagtcaaggctggggctgacattgatttaatcatgcatgacttaaaggatttaagaaacactaccgatgttagatttatggtagacaatcttaatcatttaaaaagaacaggccgcttatcaaatgccgctagtttcgtaggttctattttaaagatcaagccaatcttatctatggacgttcaaaatgagggtaaaatttcagcaattgccaaagagagacattataaacgtgcctataatcatattaaaaaagactttgatagtttaacttctgatatgccttatccaattcagttaacaatttttcatgctgatgatgaagaaagagaagctgaatgggttagtgattatgaaagtagttttcctaaggtcaaaatttatcaaagtattatcggaccagtagttggtgttcatgtaggacaacatactatggctatgatttggggcagagatttagattcttatttcgatgaaaatggcaagccgattaaggatattaagtcaaaagttgttgaagattgatactatttaactaatataattaagagaagcaagaattttattaaatttgcttctctttttaatttataactttaagagtgctaattatgaaaaaatataaatattctagttacgatattgcagatattggtgactatttaaaagtttttgcttgtacggcggtcatgtcgcagccaattatgagccttattattaatctgccccagtctcagcaaacgcaagttggttttggtattctttataatctagttaaatatactgctccagcctttatttttggtattttatacacgactattaggactagtgacttaaacggtcatttctcttacttcaagcatctgcaaaagaattggtccaatctctttgtaccaacgatttggtggactttaatttatttattagggatgccatggcttcagcaaggtaataagtttaatagctttggtactttttgctggcaatttattaatggtaatgcagcacctcacttatggtataacacgatgatgctacagtttattatcctaatgccgtttttctggttaattagtcgctatgtaagaaataatattaaacgtggttttgcagtggcaattgttactttaattctttacttatcctggttagcattttacgactattatgtttttcatggtgttcaccaaaatgactggtatttattagatcgagtatttatctctttttttatttatgctgtttttggtggtttagcatggcaatttagatcgtactttaatgaatttataactaagttttggtggttaattgtagtaatctttattctttgcttcatctggactaattatgaattaagtcaattcggttatcctcttaatttctataatgcgccttactataaaccatcaatgacattttactgtttggcagtaatttgcttaattgctgctttctgtttatatcaagttcgtaaaagacaaataaatagcttgaaaatattccattttttagctatttatgcttatagagcctatcttgctaatgtcttttggaatcagttaatctggcacggattaactatgcaatatcatgcaaaattccatccatttttaaccttatttggttgctggttattaacctggatcttatcattttcatctgcgtatcttttacatatgtggtggacaaaagtaaagaaaatgatagctagaaatacccacctatatatctaaaaaactctgaaaattgccactaggagcagttgtcagagttttttatctttagtatttaatttttacatgcaagttatcatgatttgacatatcgtataacgtttgtaaatacaattcataatgtgggttgtccgcaattaaacgttgataaattggtgactttttaagtttttgcaattcttcactttcaatatgattttttccagtaaaaaagtgataattcatttcgccgaaaagacgccccatttttctgacagtatctaaatcatcatgattttgataaagatttttctgcattaattctgccgaaatagttcctagttgaatattttctaaataatcatgaaagtgagttaaagtccagttttgtttttctttgtcagttaaatagtccttcatcttaaaatgatgacaagtataactaacttctttcggcgaaactttaactaccccatagccttgatcattggagcaaaaactagcagttacaacttcggtagctgggcaaggatcttgcggcaacataatattctgagcatgaatatgaccagagaaaactaatttcacattatattgagctaataacttacgcagttcacgataatcatcaacaacatatcctttgtttacagctggattatgagcatagaggttatgatgcatacaaaaaatcacttgaagattattctcactagcatattgaagttgcgccttaatccagcgtcgttgctctcttcctaaaaagccagctgtcgcaggtgcagtagtagcttcttctttaccatagtcattagaatcagctaaaatcaacaaataatcaggattaagctgaacactataagctaaagattcatcatcaacactaactgcatttttataggatgttttaaaaatattacgccacattctaggactaatttgaccagcgtagtattgtttctttccgcggaattctctggcccagccatcataaatatcatggttcccaggaagaactaaaagctgtgtttcttctaaaggtttaaaaatctcagcgaatttttctgctgacactctctcgccattaaaagttacatcccccgtaacaatgattgcggccggtttctttttttgcgccattcttacaaatgcgcttaaagcagtttcttgatagtatagatctttaccctgactagttttttgcatttgtgaaaaagcctgtccatgatcatgtaagctatctgcaattaaatgagtatcactaataacccaaaaactagtcttcttatcttgcgttaacataattgttatctcttattagcccaatattgataatagtcggtccgtaaattaccattatagaattttctcttcttagtggcctttgcaccaaagtatttttcaaattgaggatcagatgtaaggtagtactgactaaaagaagtaagaggacgcaatgtctgtcccatttcttcatagatcttttcagctgcttctcgatccttaagccgtttaccataaggaggatttgcaacaataactccattttctaagtcagttgaaaagtcttttacagcgacttgcttaaattttatatcttgtaatacgcccgcattatgcgcgttcactttagcaatttctaaaattgattgatcaatatcgctagctaagattggagcatgttcctttttttcttgtgctttagcttcttctactaattcgggatgcaatttcttatcaaaccaatcaaaattatcaaatgcaaatattctccaaataccaggagctacattttttgccttaagagccgcttcgattgcaattgttccggaaccagtcataggctcaataaagggatgagaaccatcaaaaggagttagttcaatcaaacctgctgcaaaattttcttttaaaggagctccaccatgctcgacacgatagccacgtttaaataaactttgaccagtagtatctaagcttaaacgtgcagtgtctttgtagagatggatgtctagcggatactcggccccgctttctggtaaaaatccacgtcttcgatattgatcggtcaacttatctacaatagccttttttacaattgattgaacatcaggttcagaatgtaacttactacggacgcttcttccctttacaggaaattgagcatctaccggtaataattctgcccaatcatagctataaacttcatcatataattggtcaaaactggtggccttaaattcttttagtaagatctttacgcggtcagcacttctcagccatagattagttcttacaatatctttttgggttcctttaaaaaatacacggccattttcagttgttgtttcataacctaaattgtttaattcttttgcaactacactttcaaatccagcgcccattgttgcatataatgtatattctttcattttatattttctctatctatataaatttttctataaaaaaaggctgagccaaagctcaaccctaacctacaaatctctataagccacgttctgttccaataggatttggttaattcctattttcagcgaccatctatcttcattaaaaatgacctcgtctttagttcatttacttagacgaaagcgcccctaccaaatttgggttgcccgcttgcagggtttacctcgttccaccagcaaagtttccttcactgcttcgtcactgtggcacttttcaggatagtcacacatgtcaaaaatgatttagtgctttttccgccgtaacttgtaaaaacaagttccccagcttattgggctgagtacaaaaactacaagcatctcagcttgtgcgtgcgtggactttcctcagctagcataagctaaccgcgatcgctcgaaatttgcaataattattataccatagttttaattagcttggtaagttctatcttgttgattcattctttgttcaaggttgtaaactttacgctctaaagtagaaatacgttgaatcatagcaacattagtagttaattccggtgcttctttgtcttcattagtattatttacagcagctttttgtactttctgaggagtataagttttaacatcatcttcaatttcctcattcttaaaatctaacttaggtgcagtacttttagctgtttgctgtttttgttgagcttttaaatcactgatttgtgtttgcaaatcttcaataatagtcgcaaaagtactgtagtctgaaataattgtatcaagatatgaatctacttcatcagaatcatatcccttcatttttgttctaaattgcttttttaaaatactttgtggatttaattgaatatcatttaaacttgccattggtttcgtcaaactccttagttacagactaacgtctgttttaatttaggcgataaaatgttagctagttgatagcttaatggcactcattctatcgtatacaactagtataagttataagtatccttcaagcaataatagtaataccatctaaaaaaaatcttattttcttaggtatataaaaaattaaagagtatatttattttcaataaaaattctttcgatgattttcttcatattcttctgcagcttcttgtaagtcataaaaatcaattatatccagtggatagtcacttttttcttgatactttttaatggcttcatagtcatattttgttttaccgggatgctcaggatcataaagtaaaagagctcgatctgtgtgttctaacataaaattttgatagtttttaagctgcactggcctcatgtaaggatagtcagaagtagaagctgtaaaatcaacctgctcagtaaggttttgatatttcatttgattactatcattccattcttttgagaattctaaataaggtgtcatcaaagccgtatgaacactatagtcattctgcaaactaattgctgtttctaggccccattgttcggttccaaggtttgccccactaattacccagtcaatctttccttcttcaagtaaactctttagataattgcttagagcatacttaattacggtcaacttcggatctttatcgctaaaaactcccaattcataagaacgatatccggtaacccatagtcgcttcattctgatccttcctttctctaaaaatgatttaaaatctttgctataatgctaaacaggagtgatgttgatggtaaaatatccaacaggcagtttaacacattatactaaagatcaaactgaccttttacatccaagaaagcaaaaacatcgtaaagatgttgtattttctgatcgtggaatgagcctagaacaacaaatcaatgagtctaataagtattatcttcttgaagatattgccgttgttcataaaaagccaaccccagtccagattgttaaagtagactatcctaaacgatctcgtgcagttataaaagaagcttacttcaggcaagcttctacaactgactataatggcgtatatcaaggacgctatttggactttgaagctaaggaaacgagaaataagagcttgtttcctttaaagaacttccatgaacaccaaattattcatcttgaaagatgtttaaagcaaaaaggaatttgctttacgattattcgcttcgtaactcttaatcgatattttgtaactcctgctagttttgtgattgaagcttggaagacaccacataagagttcaatgaccttgcaagagttaattgataattcaattgagattaaaagtggatttcgcccaactctcccatacttggatgcaatcgataattttatagatagataggaacaaaagaatggcagataataatcaaaggccaagtaattctagaatggctaagcttcacccaaaaggtaagcctcgtaaacgaatttggctacaaataatcaagtggttctttatcgtagcaatgttagtagttgtttctggagtaggtttatttgcatactatgctaaagacgctccaagcatctcacaggctcaacttcaaagtggtgggacaagtagtctgtatactcgtgatggaaaatttcttctttctctagggtcagaaaaaagaacctatgttgataataatgaaatccctaaagaacttaaaaatgccattgtctctgttgaagataggcgtttttataaagaaggcattggactcgatccaattagaattattgggtctgtcttagttaatgctaaaagtaaaggcgtagctgcaggtggatcaactattactcagcaattagttaagttatcggtcttctccactgctgcttctcaaagaacccttcgtagaaaagctcaagaagcatggctttcaatgaaggtagaacgagaatttagcaaagaacaaatcttggaattttatattaataaagtttatatgaactatggtaattacgggatgggtacagcagccgactattactatgggaaagatctaaaagatcttgatttagctcagactgctctacttgctgggatgcctaatgccccggttacatatgatccatatgtttatccagaaaaagcaaaatatagacgtgacattgtattaaaagcaatgctcagaaatgataaaatttcaagagctcaatataaacaagcagttaatgagcccattactcaaggcttgcagcctaagaagaataattctacttctgaattacgaaaagtagatgatccatacatcaaagaagtaattaatgaagttaagagtaaaggctttaatccatacaacgataacttaaagattacagttaatattgatcaagatgctcaacaaaagctttatgacttagtaaatgatggttcggttccatttactaatgataagatgcaagttggagctacaattattgatcctcgaactggccatgttattgccattattggtggacgtaaacttcctgcagttcaattaggtttaaatcgtgctgttcaaactggtcgttcaactggttctactgttaagcctgtattagattatggtcctgcaattgagtatcttaactggccaacttctcatatgttagatgactctaaatatgtttaccctggtactaacattcaactttatgactgggacaataaatatgagggtaaaatgactatgcgtcacgctcttgaacaatctagaaatgttccagctgttaaaactttaagcaaggttggagtggcaagagcttctctttttgcaagaaaactcggagttaatgttccttctgattctggtctatcagttgcaattggtgctaatgcatcctctcttcaaatggcaggcgcatttggtgcatttgctaatgacggtatttaccacaaaccacaatttgtttcaaaaattgaaactccagacggcttgactagaaattatgatagtagtggtacaagagtaatgaaggaatcaaccgcctatattatgaccgacatgcttaaaggggttatgactaaaggttcgggtacacaggcacgtattaaaaacttatacgaagctggtaaaacaggaacggttaaatattctgatgaagagttagtaagatatcctcaatacaaaaattcaccaaaagattcttggtttgttggttataccaaactctattcaatgggaatttggacaggatatgataatctgaaagatggtactccttcaggtgttggctcatcgtctgctcaacttctatataagcaaatgatgtcatatttaatgagtgataaagctaataaagactggtcaaaaccaagcacagttgttagacgcagaattgctaatggtacccaagataaagtcgtttctccgaatgcaagtaattctagctggcaattatttgttaaaggtcatgcaccaagtaatccgtatagtgatgtgactgttgatagacgaaaagaggaagacgacgatattgatacacgagttgatacagaagatgatacttcttctaagggccaatctcgttcccaaagcagtagttcttcatcatcgagtcgtgctgaacaatcttcaagtcaaagacaatcttcttctacttctaacaacaactccaatactcaaacgcaaaataataatcgccagactgaaaaacaaccagaaaataataacaataattcacaacagaatcagaatacaaataatcagggtaacaatcaaaatcaacaacaaaatcagggaaataactccaataataatcaataattgaaattaaactaaaattaaaagatcccaaagtcgttaaaacgactttgggatcttttttacattatttattagtttaatggtggtaagaaagaatacggatcttgatttttagtccgagcgggcattgtatatctgccgaataaaatcatagcatgatgagtatgaatccattcttcttttggaagcaattcttcaagccgctgctcaacttcatgaggagtcgcttttgcactaacgatattaaatcttttagaaatacgagatacatgtgtatctactgcaattgctggtactttgaagccttctgctaaaacaacattagccgttttttctcccacgccaggtaaggtcatcaaaatctttttatctttcggaatctgaccgtcaaatttttcagtaataatttgtgctgtctcttttaaatgtttagcttttgtacgatataaaccaattgtacgaatgtgattttcaatatctttgatatctgcttgggctaaagtggcactatctggatagtccttaaagaatttaggtgtagttctattaaccattttatcagtggtctgggcactcattaaaacagcacataataggtgaaactttgtgtcccaattcaattctcctttagcatctggatataaagaaagaatcctttttaaaaccaatcgtgcttcatcgtctgataataattcttccatcttaattacctagtttctttgaagaaaatttttaatttgatctagcgtagtaaggccatggcgctgccaatttaggaggattctgtcaacatatttaaaattatatacctgcgctaaaatggcttctctaagagctagcttgactatttctggatcatagtgatcaatattaatccaagcagcaatctcttgtttttcaattgggctcaatagacgaccaaattctatctcaaattgtcttaccaactcttgaattggatttgcggattgttgagtagatgtagaggatttaaaagtagcttgatcttgataagattcttccctctcatcaataagcgtatctaatttctgatataaatgatttaaatcatagaaattagttatgcgaccttccccatcccttttttgccccaattcaattaaatctttatcaattaagttttgaattagctgggaaatctcaatcggagataaattcattctctctgataaattgttatcgctagggaaaaactttttctcctgtttgaaagattctagctgcaataacaacattgcttcagtttcagatatttttaaagagggatagtaacgtaaaagactattagaaataaccgtaaaaccttcattttgaatagccgaaaaagacgccatataattttcctttcaaaaaaagctgaactaaaatagttcaactttttatatttatgatattagattatcaattatggttgcattctgttgatcaatcttgggaatggaatagcttcacgaatgtgatctaacttacaaatccaagcgattgtacgttcaaatcccataccaaatccagagtgaggaacaccaccgaatttacgcaagtcaaggtaccattggtaatcttctaagttaagacctgcttcttcaatttgttgtttcaaaatttcgtagttaccttcacgttcagaaccaccgaaaatttcaccgtatccttctggtgcaattacatcagcacataaatattctttaggattatcaggatttttcttcatgtagaaaggcttaattgtggttgggtagttaacgatgaagactggacgatcaaattgttctgaaatgtatccttcgtcaggtgcaccaaagtcgtcaccccatttaatatcacgaccagcttcttgaagcattttaatagcatcatcgtatgaaagacgagtaaagttaccttcagtagtcggacgtaatttttcaggatctctacccaagatctttaattcatattcattattttcaagaacttgtttaaccatgtaagccaagtatctttcttggatatctaaagactcatcttggtgcatccatgccatttctggttccatcatccagaattctgtcatatgacgacggcccttggattcttctgctctaaatgttggtccaaaagtaaagatttttccgtaagccatagcaccagcttcaccatacaattgaccagattgtgacaagtaagcatcattattgaagtattctacatggaataattgtgtagtaccttctggagcagaatgcatgaagataggagcatcaaacttaatgaatccttctttttcaaagaaatcaacagttgctttaaacatagtatttctaatttgcataatagcaaacggacgcttagatcttaaccataaatgacgattatcgagtaagaagtcaacaccatgttccttattaccaattgggtaaccttcgttgttagaaacaatttctaaatctgaaatttgaatttcatagccaaagtgtgagcgcttatcttcgtgaacagtaccagtgatgtaaaaactagcttcttgacgcaaagatttagctgcttcaaaaacttcttcagaaacatcattcttacgaataacaccttggaaaaatgctgttccatcacgtaattgtaagaaaataatcttaccacttgatcgtttatcagttaaccaaacatgcattttaacttcttggtctacatgtttagaagaatctttaattgagattaattctgtcattacttaccaacctttttaattaaatttaattttattatactaaaaaatcactctttagtttaacaaatttataaattatccgcatagactacttcttttccatttctaaaatcataaagaacatagccataattaccatttttctttttatatgttacttcccaaactggcatccccttataccaacctagctggcatttagggttattgtgtccaggatgctcatcattaaaagtatttaaaatctgttcttcacttttacctttatttgcttgataaaggtaagcttttttgctttttggaagataaatgaagtaatactttttccccttcttactcattccttctaaactattgctctcaacgctacgacttaaatggtagttcttggtaactgtagtaattggggtcttttcaagggcaatcttattagtttctttaactgtgtcacttgctggcttagttgcaatataaaacacaatacaaagacataaataaattgctgccaaaactccaaccacaattccagtgattttaagtcctttttttacatatctattcattctgtttactattccttaaaacatttagtagttgttgcttgctaacctttttagcactcacaggtagtcctgataaaaactgttcgccataagatttattccaaactcgttgatctaaaactacaaagactccatgatcacgctcatttctgatcaaacgaccgcatccctgcctaaatcttaaaattgctcgtggaagtgtatccacttcaaaaattttatcagctccaacttgcttttttaaacattctgttcgtaattttacctcgggttgatcgggtgactcaaaaggtaaacgcgtaacaattgcaagatctaccccattatgtttaaaatcaattccttcccagaaactatttgctccaagtaaaatggctttttcagcaattccgaaacgtttagcaattttttcattagaaccagttaagccttgagccaaaatttcatagtcctttaaagcattactgttttcacttaatctgctaaaaacatcccggataacatctaaattagtaaataaaactaacacatgcttatagtctttaatttgagtaagtaaattactaataaatgtttcatattcaggactgtttggatcctccggagcattattatcggaaagtgcatatacttttaaatgcttttcaactttgaaagaaggctttgctcgataagtaagtgtttttttaggatctaaatataggtttttgatagtgtatgagaagtcgtcttgttctgctaaagtagcagaaataaataattttttatcaaagtaatgatataactgtttaacttcttcttcaggatcaagtgttaaccaagttaaattagtagatagtgggtcatcttcattacttatttctaaaacaaatccttcatggtctaactttttagggtcacttaattgatcaagtaaaagatagttttgctctgagtaataatctaactgatctatttcttcctgaagatctcttattaaaacatcatcgctcgttaaaagattcttttgttgatgatatagcaaaaataggagttgattagtctcttggcgcacaatttcaatattatcttgcataagatttaacaaatgcttgaagtgcccaatattgttgaacaaatcctgtccctgaaatccgagactaatagcattttgtctcttctcttcccaactggtagcaaattttcgattatcataaagggcttgctggatcttgttaatagaatgaattaaatcatttgtatctttttcaagtttatctaagatcaatttgaattctaaattattaccaaaacgtgccttagcactatcttctgcataaaaaagtaagttacgtaagtgactacacatcccccagaagctttcaaattgaagtgaatcatttcttgaacttgctacattttcaacaaaacgatgcgcctcatcaacaactaggaacggattctggccccaaattgagtccatatagtgattagctaaataggcatgattagtaattaaaatatcagcttgttcttgtctactacgtgctaaattccagaaatcatattctgcaaaggctgttccaattctcgcatctccaggatgttcaattgctgcaaagagaggtgcctcatagttagttaactggagttcatctaaatcaccagtttctgtttcagtaagccagatcaaaatccccatttgtaaaattaaagtttgctgaatcggattatcagtctgataaagagaattgtaaaatccatctaaatctaaataatgactgcttgatttaacaatttgggcatctaagtctaaatgagtaacccgtaaaagttgcggaatttcctgctttagaatttgttcctgtaaaaccttagtgggcgttgctacgactaattttctcccagaatatagctcatacgcataagccattaagtaactaaacgtttttccgctaccatttggtgcttcaacaactagtgagttatctgagtcactgtaaacaaagtcgtggagtctattaattagactaacttgtccccgtctaaagcggagattctttttaaataattctttcttttcatcatcgctttgaggaaatgatccaggacttgctacatcattacgacgtggagctatattttgctttttcaatattaaatgttttacctgaaccaaatctttaggcaacggtctcttagtctgccgagcaacttgaccaatttcataaaaaatataatcagtatctcgtagcagtccttttgataaggaagtcaaagtattgagagttgcctgaggaagattttccagtttcttaattgcttttagtagtaactttgccgttactagtgcatctgaatcagctcggtgcgggtttaagtgtttaattctcaagcgagctgttaaatctcgtaatttataagatggaaaagttggaaaagcaatttgtgctaactccaccgtatcaactgcttttccagttagtggctctaagcccgcatttacaagctcatagtttaaaaacggaagatcaaagtttacattatgtgcaacaaaaatcgtattttctaagatttttcgtatctttggtgcatagtagctaaaatcatgagcctgcgccacgtcttcattactaatatgagttaagttttcaacagcttgagggatttcacgatgaggattgattaagaatgaatatgtttttactaccttacgctttttgatgattgcacaaccaaattgaataatatgatcgccttgattgcgctgggtgcccgtagtttcaagatcgacgacggcaaaaacatcatctgtaaaggcttttttcataataatctcccttctattctgtttctagtctactgggaccactttccttgcgtcaagcaaaattaaatattttccaattacctttttattttccgatatttcatttaatgcttgttcatataaacgtagttgcccagtatattttttcttaattttgtctatagcttgttcttcatgagttttatcaacaaaatcagttttatagtcaaataaaattaaaccttcgtctgtttcaaaatatccatcaattgttccgtgaactagaattttagctgctgagtcagaaaaatcattaaacagttcactagcattcactaagcttgagaattggctttctctatgtaatttttctggtttttgccaaaattctgccgcaaattcactcattacaaaccaatttaaagcttcttttgataaatgtggcaccatcaatgggtttaatttacctaattctacaagctcttcaatttcttgttctaaatttatctcagttttatcaccctgataatcataatactgtaaaactaggtgcatcgctgttccgatctctgctccagtaaatttttgtttttctaaaaatacgggagtctcatcaattggttgtaaatatcgattacttgaagaaataagacgtgaattctcaagttcagtatccataggatcattaaatactttttttatctcagaaacagactgataggctgtagtcttagtggcatccgcaaatggatattcaaaattataaagggttttgactacatcattcattttagaacttaatttttgagtatcgtctttttgctcatccttttcttctatatctgactgcacagcaaactttaagtaatatatcttatcttgctcttctaaagctaaggtcatgtcttcaatcgtttgatcaaattcatgcttttgttctagcttaggtcctagaaaatctagtggagactgggcattgatttttcttattaatggaaggatgttcgttttttgatcaatttcactttcccactttttctgcttagcttccatctcacttacactagcaactaagatgagcttttgttgagcacgtgttaaaccaacgtataagattctagcttcttcttcaagcatttgttgtcttttttcgacatcggctaaagatttaactagggaatcaattcgataatctttttctttaattgttaaccctagtccatctttactaatcgtaaaattgccacttaagtcacgtgtctgatacttgtgacctagtcccatgacaaacactaccggaaattcgagacctttagaagcatggatagtcattagttttacagccttatcagccttatcacttaaaagtggttgtgctaaatccttttgatttttccgcatgcgctcgataaaactaatgaattgatataatcctttaaaaccggcactttcgtaagaagtggctctctcatatagagattctaggtttactctacgctgttgtccattaggcaagccagttacaatttctaacagatgggttctttcgtaaatactccaaatcaattcagaaattcgatgggttgccgcaaatgaacgcagagattctaattgctgaaggaagtttttacatttttgaccaagatccgaattgactgatgcaaagctggttaaagcattataaaaatttccggatctagttttgaccctgatttgcgctaattcaggctctttaaagttaaaaagcggtgaacgtaagactgccactagagggatgtcctgttgtggattatcaatcaatctcaagtaattcatgatcatcactaattcaaatgtttgaaaatagttctgagcatcagttacaaataaaggtagatctgcctttgcaaattcttgcattacctgtaaattgtcacttctagtacgcgtaataatggcaatatcagaatattccagcgggcgtttaagctgtgtttttcgatcccagacttggaaattctcttccttaagttgcttaattctggcaataaccatttgaatttcactgaagtccatttcgtctccgaaattttcttcaaatgaagcttgcgtttgttttttatccgtgaaaatatattcacttgcagtaggcaagtcagtaggataataagtcgcgccaaattgtaattgtccttcttttttgtaatcaattccgccaaaatttgcagttagaattggattgaacaaagagttaactgtcttagtaactctttgtgttgacctaaaattatctgataagacaattttttcactatcatcattctgtccataagcatgatatttgcttaaaaacaagtcaggacgtgcttgtctaaaaccgtaaatagattgttttatatctccaaccataaataggttgttttgtcccttctttttgatagctgcaatgatattttcctgcaaagcgttaacatcttgatactcatcaattaatatttcattgaatttttcttggtaatactcttgggcaatatgagcatttgaagtatcggtagtaagaatgctgaaagcaaattgctccatgtcactatagtcaattaaattctgttctcgttttaattgaccaaatctcttaattaattttttttcagcatcaacaatggttttaactaatttttctgattttttgagaatatttacctgttctttttcttctactacaaaaaagttagcaaagatcttcttaagttgatcatttaaatcagattttagcttttgactttcttggtaagtttcaagactttcctctgaccactttttagacttgcgaatattcttttcaaacttacaattcattagactagctcgaatttcattataagaatgatcatcttccaaagcatttaagaattgctctaaacgactggtaaagatatcgtagttttccttaaccttcactaaatctggattttccatttgaggattttcaaagaactgtcttatttcagtttgtagatcctttatctcttttattaaaagcggtttaatttgagtctgccacaggtcagattcaattaaatcatcttgaacttgataaaaattaggtaaattattgagaaatttttcataattaggctcagtaactacagtattgtacaactgcaataaaagatttcgagctccttctgcatccctatcaccagaaaaattatcatagaaatcctgaaaatcttgatcatttttttcaaggtactcaatttctatttcatggagggcacgctcttttaaaagctcagcttgggtttcatcagttaaaacactaaattgtgggtcaagatcaattacataataaaaacgtctaattacatctaaacaaaaagaatcaattgtagatatattagcagtatccacatcaagtaattggctacgaagaaattgattattaggctctttttcaatttgatcacttattttttgcttgattcgttccttcatttcacgagcagcagctttagtaaaagtgatgatcaaaagcgacgaaactggtgtaccagataaaatgcgtttcaaaacacgttcaactaatactgtggtctttcctgaaccagcggatgctgaaactaggatatctttcccataatcgttaattgcttgattttgttccttagtaaatttcgtcaactattcttcaccatccaagtctaatttttctcttattagggtcaaaagtgtctttttatcaatagatttaatcttatgatagttattttctttaagcattgcatcaaagaagaatatgtctttaaagtcagaataagtaagggatgtttgttgcccataagaataaggatctagctcaatctttcctgacaaaatctcattaccagcattttttattaagtaggagttataagctaatagcaaatctagttgatccggagtaaaactctggttttgtggccagctaatatagccgtttacttttcgtttaacactggtatatagatcagagacagcacgatctttttccattccaggttctattagatcaagcatttcttcatctgcaattaagattccgttatacattaacttcttagtactttctttagccaaatctttaatttgataattgcttaagatcattttttcactgctcaaacgttcaagactactagtaatattttggtaaaatgcgcctaaaacatctaaatccttaccttgagcaaaaaacttattattattttttaaaacttctaagtaggaaatcatctgcattgaaattccgtttgcaaataaacctaggtcaaatttttttgcggatgacttataatcgatcacctcacctaaaactcgatcatttacttgagccaaatcaactcggtccatctttccgcgaagatctacaatcttctttttattattatcatctttccagctatatgaaagaccacttaccttttgatttttaccaaaacttaattcggaatattgtggtctaaaagtcgtcttatttacattgctatgccagtaatgagctacattagctgtagtttggtctaacttatgaaatagatacttattaaatggatcatttaaaagctgacgatatctgcccttttcttttagttcttctcttacttcaattaaaagctcgcctaacttctcctccgttagatcagcaaagtttaacttcttttctttaattcttttaacaagataatcaaaagtttcatggtagtagtttcccgcttgaattacatcgagttcattttcaaagcgtttcttcaaatgtaagccataatttaggaagtattcaaaagaattttgataatacgtttctagttgtgaaacggaagtttcaatacgatcaccgtatagctgctgtgctagctcaggcgaaagatcttgaggtatattcttaaaactgctcccttcaagcacatttttcgctacttcaccaattttttcttcagtcattttcaataaagagtctacatcagtagctgctttattttttaaataggttaagtaacctaaacttgcttctggattagttataaaagttaaaacctctccattattctgaggtaaatcatgttgagcaaattcatcagcgcgagttaactttaataactgcttataaaaaattgaaggttctaattgttcatttgcagtattaattactggataagaaatataaatcttatcactagccaagctcaaagcatttccaaattggtaattttggtctaagttattgattttttgctgatcttctaagtatccattagcttcatttccttcatttagctgttctaaattttcagagctaaagaaacctggtattttttcaatttgaggcaagttagtactagttgcaccaataatgaaaacctgtttatatccttggccttgaaccatacctaattcagaaatgttaactgcatcaagagtagacggaatttgtgaaaaattagcttcactaaagccgctgattaacagatcaaaaaattgatctacagaaaacttatttgctaccagtaagtagtcctttaataagtcagttaaagttgaccaaacttgctctggttgctgggctaattgtaaatcaccagtatcattagcttctttgcgccaactttctagacgtttcgcaacacgatttttaattagaaaattccagaaaactgttactccagcttggggatcctcttctttatcaagttgctcaaaaaacttagttaaagcatcaataaagtaatctcgtagtcgatcaagatcctctacttctttctcagatttatctaaggcaattacatctgcatctacaaaactctttagtgatttcgtccatagcttcccttttataccgtgggctaagacaaaattttcaagtaggtcaacatcattttgatagcgagcagaatttttgtaccagtcagggatgaataactgcgtcttcattaaagcaattacattatccgtttgaaaaccacgcttaaaaatttgctgtagattttcaacagcaactactaggggatggtatttcatttctctttgcaaatcattaaagaaaggaatttggttttgccttaaaatcggagttaaatatgtttcatattcacttaaattaggtgctaaaactagaaaatcctgatagcgatagttatttaaggctacctgttggtaaattgtccgcgcaacaaaataggcttctgcataccgcgagtctgctttgactggctgcaaaaacttacttaaacgttcatcaaacccactcgtttttgtccaaaccccatttagtaaagagctaggacttgtttgagtaagtggatactcttgagtttgataatctaattgctgattttgccaaaaatgctctaattggccgattgtacgttgcactacgtagtcatagtcacctggttcagcgttattatcaattttgccaatttttgtcttaaaagctaaagttgtattttttgctttttttgaaattaaacgaaccgaggttaactcttgtaaagaaaaatgtgaaaaatcagaaaaataaaattccattgtactcaagttattgctttttgctaagaactgattaagcaataattgcatttcatctttggtagcaaatttttctgataaacgttcaataaactcatcataaataattcttaagtcatgaattttatagctggtctcttcatttaatttcttttcatcaatattgtctagttcaatattaccggctcgtacagataaaatagcctcatacatttgtcttaaggcaccggatgtaacttgagtttgattctgaaatagttttaattcatcttgatgatctttaacaatttgctctagtagcatgacactagcggcatcatctagaatttgtggtagtttaattgcctcatctctcaagaaataccaagctagccgtgaaaaagaaaggatgtgcaatttatttactgcaacttgttttttatttgttaaaacagagagcttgctaagtgcgcgtacttctgtggtaaacttaatatggtttggcacgataataaaaacatcgtgtcttttatcttggtagtatgacttaacagcttgatcaattatttcattttgcaagttgtctacttgtctaccagtaattacattaatcataagtctctagtctccttagcaaatattttagcatatgagacaaggcaattagacttaatgaaatttataatataggaaagataattgtgaataaaaaaatagaagtcaaagcacatggaaaagtgattcttattggtgagcattctgtagtttatggctatgatgccctcgctcttccaatccaggccttaaatatcaccacaactgttgaagaaactgatggtcctacttggatggatacaactcattatcatggtgctttttttgatgcgccggatgaatacgatggtattaaatatattgtgaaaactttacttgaaagagtagaaaacgctcctaatcttaaaattacttatactggtgaaattcctatggaacggggttttggatcaagtgctgttgtagctttaggaactaccaaggctgtttcacaatttttaggattaactctttctgaagctgagatcatggaaatcactaatcatgcagaaatgattaatcatggaaaagcttccggccttgacgctgctaccgtaaattccgattacttagttttcttcaataaacaagacggaccaaaacagctttctcaaaaattaggtgctaccttattaattatggatacgggtgaacttggaaataccaaagtcgcagttcaatcagttaaaaagcaaatggatgaaagtgatcttaaaaagaaacaaattgcacggcttggagaattagctaccgcaacacgacaaaattggtttaaccaaaatgcagaagagatcgggaagatttttaatgaagccgaagacatccttgcctcctttaagctttcaactgaaagaatcgataatatttgtaaaattgccaatgaaaatggcgctttaggagctaaattatctggtggtggcttaggtggcattgtaattgcactatgtcctaatcaagaagttgctaaaaaaattgccgaaaaagctaaagctaattttgataatgactggattgaggaaatttaatgaagaaaactgctcgtgcccacactaatatcgccttaattaaatattggggaaaagctgaccaagctttaaagacaccgttaatgtctagtctttcaatgacattagatgccttttatactgatactacatttgaacatgattcctcattaactgaagatacctttattttaaatgatcaaaaacaatcagtagaagacagcaagcgagtttttaattatattcatttattacaagaaaagtttggcgttaatgaccactttacaattcggtctacaaaccatgttcctacttctgctggccttgcttcctcagcatcagcttttgcggctcttgcaacaagctttgttgcaagctatggattagatctttctaaaaaggagctttcaagacttgcacgccttgggtctgggtcagcgactagatcagtttatggcggctttgttgaatggaaaaaaggatttgatgatgagagctcctatgcagctccaattgatgaaaatcctgatcttgatctttctctactagcaatcgaagttaatacaaagcagaaaaaaatttcttcaacaaaaggaatgcagttagcccaaacctctcctttttatcaaccttggttagctagaaacgaagaagaaattgctgaaattaaacaagctatccaaaataatgactttactagaattggtgaacttagtgaactaagtgccaacgagatgcacgcttgcaatttaactgctaaagaaccctttacttattttgaaccggaaacaattaaaattattaaattagttgaagatttaagaaaaaatggcatcgaatgttactatacaattgatgctggtccaaacgtaaaaattctctgcaccttaagaaatagaaaagatattatttcagctgttcagaaaaccttgactaatgttaaaatagtcgttgcgagtttcggcccaggcgttactctgctttagtaatttgaaaataaaaagattagaggaatattcgttgattacagaacaagcaccaggaaagttgtatattgcgggagagtatgcagttcttgagcaaaactgccctgccattttagttgcagtaaatgaatttgtacgtgtttcaattgcaaagagtacaggtacaagtgggttaattcattctaaacagtattctcaagattcaattcactggatccgtaaaggtaaccaaatggttattgataatcgtgataatccgtttgaatacattttatctgctattaactttacagaacgtttttgtcttgaacaaaaagtttcaatgtctttatatgacctacatgttaattcagatcttgattcagccgacggtaaaaaatacggtcttggctcttcagcggctgtaacagttgctacggtgaaggctattcttaatttctatggattacactgtacaaaagatcttatttttaaactttctgctatttctcactatagcgttcaaggtaatggttctgctggtgatattgcagcaagtgtttacggtggttggcttgcttatcaaacttttgataaagcatggcttaagaaagaattagctactaaatctcttagcgaagttttaaatgaagcttggcctggtcttaagattcaattattaactcctccagaaggactaaacttggtaattggttggagtcaaaagcctgcttcaacttctcaattagttgataaaactaatgcaaagaaaaagtttattaagactcaatatgacacttttttagatgaatcacggaaatgtgttcttgatatgattaagggctttaatgaaaaaaatatttctttaattcaaaaacaaattcgtttaaatcgtcagttattaaaagactttgcttctcttaaccatattgctatcgaaatcccacgtttaactaaattaattaatattgccgaacaatttaatggcgctgctaagacttctggtgcaggaaatggcgattgtggtattgtgattgcagatgaaaaaactgatatcgaagaaatgaaaaataattggcgtaaaaatggaattatgccattgaactttctagttcactcaattgcttagtgggaaaaattatgtcacaaagatctcaaagaaaagaagaacatctagcattagctaagatgttttttaatagtaataaagataatgattttaatcatgttcatttaatccgccctgctcttccagaaagtgcaataagtagagatagtatttcaactgaaatgtttggtcatactatcagtactcccttctttattaatgcaatgactggcggctctgatacttcctataccatcaatcaacgtttagctaaagcggctgccgcagaaaatattccgatggctttaggatccgctagcattcttgaaaaagaaattgatcaaatagagagctttgaagttgcacgtcaagaaaatcctgatggactaatttttgcaaatgttaatccaactactgatccaaaagtagctcaaaagattgttgacgctttagatgcaaatgcattacagattcatcttaatagtgttcaagaagctgtaatgcctgaaggcgatcgagattttcattggatagataatctaaaagaaattagagatacagttgatgtgccaattattattaaagaagttggaatgggaattgatcctgaatctcttcgtacccttttaatcaatgacttttcaattatcgatttaggtggaagtggcggaactaattttgcgcaaattgaaaatgaaagacgaaagactcaaaaattaaactttttagaagatattggtctttctactgttaaaacgctgcttgcagcacgcactatccctgttaataaaactattattgcagctggtggcattacaaatgcactggacatttttaagtctttagttttaggtgcacagtatgttggtattgcaaactatttcttgcagtatgctagccaagattccgagactttgattgctgctattcaaaacttaaaatatgaattgaaacttttaactgctctatttggtttagatcatatttctaaagccgatgaagttagatattatttggatactgatctttacaatttcactcgacaactctataattagtgctatttcgttggatggctgctataagcagccatcctttttgttttatttattttttaaatgttaaagtaacaattttattaatttaaatataaaaagtaaaaaagttcattaaattaaatttggatcaataccaaaagttaatttaatgaacttcgttctactaaataacaaaagctaattaataatgtttttattcttttatcaaatgaatttcccggtcaaataattcatgcatttcttcagtaaaattatgggcaataaatacaattgttgctttactttttaacaatttgtctaaaatatcaatggttgaattttgatcaatcgcacttgtcccttcatcaattaaaataatatcactctcatgaacttgagcccttgctaaaacaattttctgcctctgtcctccagagatgtttagtttatcaagatccaattgtttattaattccctcctcaaatttttgcagatcagcagataaatttacttcttctactgacttttcaaccttattatctagcttgttgttaaacatagtaatgttttctttaattgaagctgggaatataaccggatcttgcggtaagtatccaattgttttcaaatctggattaatttcatttccatccttatcttcaaaaataatcttcccagcactaggtgctaattctcccaatattaatttaaatagagttgatttaccagtaccagaatctcctgttaagagaatcttttcaccctgattaatctgaatatccggataacttagtttttcgccatttggaaaatttagtcttaatgattctgttttaattacagtaggcatatttgttttttgcttatctgaaacttgaactttttccgctgcttcatttacttcttcaattagactctttactcccttcatttctcccctagcctgagagatttcattaattgcttgatttaaataaaatctgaaatttcccactattaatagagtactcatttgtactaagccatttttgactaaaaatccagtcaaaacaaatatgatcaacccaaacaatgcagaagctatcccgttaatcgcattaagtaatttagtataagtagtttgcttaacagttgcgtcttcaagttttttactagcattttgagtgacagaaaatagctttgcaccagctgcaaattgtcttaattgatctaaaccgcgtagccagtcgtttaaagtatctaaatatatttcattgctagtcgaaataagtttattagctttttggagtggtttttcaatcaattttggcaaagctagagaaatggctacaattatacaaattgtaattaagagagcccaacttaacataattaaatatatgataattgcaataagttgaacaactccaaaaattagatttagaagagagccgtagtaattatcattaattaattctaaatcattagttagtctactttgaatttttgaaaccggatgatctctatcatcatggaaataataatctactatcttttctcttacactattatttaaatcttgcgtttgagcaagaagtagatattgggtcaaactaaataatgcataaaacattatacatacagttaaactaatagctgaaattatcaaaaaatttggtaaatttcttgaaagaataatactcgtctctatttgaactaaggccgtcatcgcaattgttaaaagaggagaaagaatagctaaaattgaaaacagaaaaaaacgtgtcctattaattcgaataaaatttcttaaattcattattcctcttcccctttcttagctaactttatttcttgatcaaacttagctcttaactctggtgtaaaattatgggcaatcattaaaattgtctgatcagtttttagcaacgcagtaataatctcttcagtagctttttgatcaattgcactagttacctcatccattaatacaaatggttgatgataaatttcacttctagctaatacgatcttttgtcgttggcctccggatagattatttttctttaaattaacttctgtatcaattccagaaggcaatttatctaaatcattttttagttcgacattattaataatattcattaattgtttttctgttcttttaacaaacatcgttatattatctttaattgaaatcggaaaaactattggatcttgcggtaaataaccaaggttagcattggttattggtcgactttctttatcaaaataagtaatcttaccacatttagtctcaattttccccaacaatgctttaaataaggtggacttccctgttcccgaatctccagttaaaagtactttttcaccaggtttaatagtgaaatttggataagtgagagtctcaccttcatcgtatgtgactttcaaattttcaaccgatacaccataagcagctgtctttacaggctgcttttcttttttacgtaaagttaaaatttcctctcttaatgttttagttgatttaactaaagtaattgaatgggtaatttcccaaactgctgaaaagatagctgatccaaatgcacccgctacagcgaattctccaaaagaaatcacatgatttaagaataaaattcctgcaaaaaatgatattcctatttgtgctaaggcatttccgaaaccattgaataagtaagaagtagtttggtaccgatagtttttcttatttgccttcgtgtaatcgtcacttgccttatgtagctgtcttctcaatctctcatatgcactaaagcgtcttaactcttgcagtccaccaaaccaatgttcaatcgtatttagcaacttttcatttttatcatttacgttcttagttgcctgagctgttttcttttccataattttaggtagaagaaaattaatcgctagtaatatcgcactaactaaaattaagctccagttcatagtaaataacaaaacaactgcgattaaaatttcaagagttccactcaaaattgatacccatggcatagcaaagttggtagttaatagcttaagatttgctgttaattgattttgcattttggaagttttttcatcttctgaagaagcatagtaatgctcaataatttcttctctaatcttatgaacatagtcttgggtttgtcttgtgaaagcaattgttgcaattggtaataaaactgccgtccctatttccatcccagcctgaataaaagtccaaaaaagatatccatttaagttacctttaagaatattgtttaatgaatctttaaaaagatattctcccattgaacccgcaactgcatataaaatatacaaacaaaaaatcagtattgaacggggaacattaattttaaccaactctttaaacgtcattatttgcccctcctatttttatttgttattaattatactaatatttttttaatttacaatcatatttttataagcggacaaatttatgacctaagtggtatattttcggacttaacgagtatgctatacttattttatctatgataaatcgaggtgattactaagtgtttattctaaataacttaggattaagcttaaaactgaattattttctttcagttattaagctatatttaataaatatccccaaatttgatgaaagtttggggtttgttaactaaaatctagctatcttttccctaaactttcatgtactcaataaatttaagtattaaaaaggaacgggaaaatgactaacaaaaataactataacattataaacctcttaatcggccggatcggaacaaatgttgctgactctcttttctatatggcgatattgtggtactttaaaacccattttaattcaccaatgcttctttccgtaatattcatagctgaatctagcattgatatgttttcgtttactttaggacctataattgatcgtatagatatcaaaaaagcattaaaattagtgacaattactcaaacaatgctgagcgtaatcattattccgctatttaataatcaaaaattacactttttaggaattacatttttgatagtagtctatgttttgtcaactatcggctcaacattaatctatcctgctgaagacaagatactgcccaatatagtagaaaagaaagaattacctaaagttaatgggatttttcagatgtcttatcaaactttagacttattcctcaatgctggagcaacaattttaattacctttttatctataaaaaatacaattattatttcagcattagtatttgcatttgcacttttgttctacacgcgtttacactttaaacttccagctgcctcatcacctgaaggtaatactagctatttcaaatatttagtaagtggttggcaagcattacgcactaataaaaatattttaattttaatcttgccttttgctctaactaacttattttatggaatatcatctgttggtttaccttactttgccaccaaatacttaaacaatagtgcacttagctatggaagtttagaacttgcctcttcaattggaggattactaggcagccttatcgtacagcgactttacgtgaaagacagccaactaagactattaattgttacttgcttaatgctatctggattagcaattgttttagaagtaataagtgccccaatttggcctattttaattctaatatttgctctatgtagtactttctggattagcatcatgaacatcaattttaaggttctagttcaagaaagtttttcttctaatttattaggacgaattatcacgattaacagcagcattgttaattgcatgattccgattggatcatttttaggaggatttattgttaaaaactacggtgctcgtgcagccattattcttgaagggctggctcagctagtaacagctgtcttctatctaataatatttttaaaaagaaaaagagcataaatgctctaactaaggagttttctaatgagtaataaaaaagtaaaaattaataatgctgaaataaaaacaagagtagttttctatcgtccaagtcaatgattaattttaatttagaaaagagatttttatggcgaaagatttgattactacagttacaacaaaaaatgatttcaaacaggcatttaacagtgctcatcttaatgcctccgacacagctattgtccatacatcattaagcaagttctactatattcccggtggtcctgaaacggtcatcctggcacttaaggagacaataagtaaaggaaccattatgatgccttcagaagtttcgacaaattgtgatccagcaagttgggagtatcctccagttcgttctgatctaattcaaacaattagagataatatgccaccctatgatccaataacctcagctactgagggactcggaagaacacctgaatgtttcagaactctgcctgatgtagttagaagtaaccatccctatctaccaatcgcaatttggggtaaaaataaaattcaaatagccaaagaacaaccattaaatcttccatacggcattaatagtcctttagattatctctacaaaaataatggtaaaatagtttttctagggacagactatgaaacttgtactgcccttcactatgccgaatcaacaattaatcggccaaccgaaacatggtcagctgctactggtcttgatgatcaaggtaaaactacctggactaaatatcaaaatgttgacctagactcttatgatgattttaatgagctcggattagcttttgagaaacaatatcccgagtgctttaaccaggtgagcttgaacaatagttttatcaaggtaatcgaaatgagacctttaattgactttgctagagactggtttaaaaagaaagataataattgataacaaaaaaagtaggatttaaatcctacttttttctataagtttctttttttacaaaaactctatacgttatacgatcactgtcatcgtagcagctccgataatgatggctaaaccaattaaagtaactaccatttctttcttagtcttcttttcatgcaaaaaccagattcctgttaaagttgctaatactacagatgtctgtgacaaaataaaaccagttgctaaaccattcatatttggttgagccgaaattaaatatgtcaatgcagcaaatgcaaagaaaaatccagagataatttgtttgtaagaaaccccttgagctaaagcgcttctttgacttggttctttaacttttaagtaaactgcataacaaatagcaactaagcacattccaatagcttgtggtaaaaatgctttggatccatcaattttagcagcttgaggggctgcagaatatgcccaatatccaatttcaccaactaataaaatgattacggcttttcttaacttagcactgttttcatcagttttatgttcactccaggttgtcatccaagcacctaaaatgatcagcgctaatgcaagaaaacctactaacttatcactcgtacttggccaatctcctaaagcaaatactccccataaagaagtacctaacaactgaaaggcagttgtaattggcattgcgcgtgatgatccaaccaaagtaaaagaatgaaaagtaagaatctgcgcactagcccagcctattccggagataattgaccagatcaaagcagcaccgctaggcaacgctattccttgaactaagttatagactaaagcaaagataaaagtaccaaatgtagtaccaataatttgatttactggtttaccgccaatttttgaggcaattgtcggaaacaagccccatccaagtaatggccctaaaccaattaataaagctattccattcatacactaaactttccttaaaatataaaagtaattgtagtttacatacgcaattacttttatagctaaatatctactttaaaaaactactccactttccaaaattacattagaatatggagtttcttcaccagttctaataaatgctttagaagactttaaatccttctttagttctgaatgaggaataaattcaatctcaacattcggaactgtcctcttaatagcttctaattgctttggattttcagttttaatttcctctgcaatatacattttttgaacttctaattctttcaagacttcttctagaacatcaataaatgatggcaagcctggacgtacagataaatcaatcttttcagtctcagctggaactggagtaccagcatctccaactcctagccaatccatgtggcccatgtccgcaattactcttgaaatattagaattcattacgccagtttttttcatagttattaatcctcttcttaaaacgtatttactaatattctaatatctctttttaatattaacacttttaaagcagtttatgtaccgaatttattttactcgcttctctcccctacctccttaatcttgtataaaaaccacctaagagttcctaggtggttctatgcttattaaattattctactcgtcaaaaaagatttttgtatttcccatcagattatacattttctggattattgggttctggactcatcacatcgacatctaagtgaatataaatataatcaaaattattttctttaatccattccttagccctttcaaaatttaggacatttcctttttcaatcttatacttaagaatacctttttgtctttctgtaaagaagattactacgcatcattagaaattcactccttttaattgtatgataaagtctatagcaactagagagtcaagaaaagaatatattttcaattggaaaatatctggagttgtctacaaacttttacttgatgacttaatagatattctatagatttattaaaggaactttgaatacaaattttctgctctaaagtagtattttttgaaaggagcgttttcattagtgacaaatattattaacggccgtcaaattgccaaacaacttaatcaagaaaccaaaaccagagttgataaattaaaagaagaagggataattccaggaattgtagttattcttgtaggagatgatccggctagtgtaatttatacacgtaataaacagaaaaatgctgaaaagttaggcatgaaatctatcttgagaaaatttccaaaagatgtcagtcaagctgaagttttacaagcaattcatcactacaatgatgatccaactattcacgcgattttaattcagcttcctttgcctaagcatcttaatcaaactgaactaattgaagcaattgctcctgaaaaagatgtggatggttttaattcaaaaaacgttggaaaactctataacaatgaagaagggcactaccccgtttcttgtacttcccgcggaattatgactttgcttcatacttacttagataaaattgaaggcttaaatgtcacaattgtcggccgcagtatcttagtaagtcgccctcttcaatcgctcctcattaatgaaaatgcgaccgtcactatggtaagtttacacactgataatatcgattattacactaaacatgctgatattttagttgtggctgctggcaaacctaatttgattaagaaagatcaggttaaacctggtgcaaccgtgattgatgtggggattaatcgaatggcaaatcattatttagttggggatgtcgattttgatgatgtcaaagaagttgctaaaaatatcaccccagttcctggtggagtaggtccaatgactatcgcaactttaatgcaacaaacggtcgatttggctgaatggaataaatagaaaaagacgttaaacagtattacattgcttaacgtctttttctcttctattactttctctatctcaattgattcaagctagagccaaagatttgtttaatggtctgtgaatcatggtagtcaaaagattgaccaagatttttactctaccttttcaaaaacttcacataccattggtgcttgaggataaaattctttacccacctcttgatattcccaatcaaaaaaatcatcatgggttcgacgccaatattcataacttcgatcaccctcaccttcatggtaggcgtgttctttagaaattaaatcataaggtataatttccactaccttatcttgaataacacaaacaggttcttctttactattcaaaacaatactccactcacctacttggggtagtttttcatttttatcataaaattcataggcagatgtggtagctgtttttatccttcggtttaccaagtcagccaattcgtctgcatcttcagcagttgctccaaaagcccatgcttctaccggagtatcacattctaagttatgtttttgacaaaaatcttcccaaaattgtttcaattgtttattcatttttacctaattttgttaaaactttcgatccaatctctagccccgcactgtgagattcatacccccagtcgcgttcatcatagttttctatatcagccaatgtatcagcagtaaataaaatttgagcgaaatccacttttctgaattgcgcacaagccgccaaagatgcacattccatttcaacagtagcagctcctaattgacgaaagtgtgcaactttttttggcgtttctctaaagaagccatcagttgtccaagttgtaatttcatcatatttaagatttaaagtagctaatacatcttctacctgttttaagaaattctgattcaaatcgataaattgacctggctccatataatgaaaagacgttccttcatcgcgaattgcccatttgactagtaacatctcattttctggtaaatcagttaacgcccccgcattaccaacagttaaaacttgtttcacgccataactaatcaaccaatcaagtaattggaccgaagccggtcctccaagcggtgcttgacataaagtaaaatattcaccgtttaattcaacttcataaatcttaggactaaaagatactgactcaaattcacctatagtgcggtgaagatgttgatctaaaaaagcatcaatttcatttttaggaacaaatgcgtaaagcaagcgtgagtgaaaacgaaatggtgcctgatcatgatctggttcaattactgcatgatgatttgagtcaaagtttaaaataaacggttgttctgttttttctgtcataattatttctccctattttggacttaatttacttagaactttagatccaatttctaatccaattccatatgatttacgtccccaacctcggcgattgtagttttccatttgtgctaatgagtctccggtaaataaaagttgagcaaaatctacttttctaaattgtgcgcaggctgctaaagctgcacattccatttcaaccgtatcggctcctaattgacgaaagtgtgcaactttttttggtgtttctctgaaaaaaccatcagtcgtccaagtcgtaatttcatcgtatttatagcctaattctgaaattactctttcaacttgagacaagtatgcatgctctagttctacaaactgactaggttttaagtaataaaatgaagttccctctcctcgaattgcttttgtaggaatgagcattgtattttctggtaaatcatttaatgcaccagcattaccaatcgctaaaacttgtttaactccataattaattaaccaatcaagcaattttgtagctgctggggcgcctaatggtgcttggcataatgtaaaatatttattttcaattttgacctcataaattttaggtctaaacgaaatagtgcggaaacttcctagcgtgcgatgaggatattgatctaaaaaagaatcaatttcttctttaggaacaaaggcgtaaagtaatttgggatgaaagtggaacagtaagtcttcaaaatctggttcaagcacggcatgatgattcccatcaaaatctaaaataaatggttgtcctgtctcttctttcatacctactccttctacaatttttgtaatatctcaaagcaaatttctaatccacgccgaaatgaaatttaaacggttgtttttcataatcgggttcaataacagctttgggatctttatctatttgtaaaatacatcgctcttctttcatacatactcctattcaaaaaatggataatcaccttgatagtaatgctcaataaactttaaatgctgcttattaaaaatatccggtaaattatctttaggaaaatattttaactccaatgtttctgaatctggtttcttattcgttttgcctactagctctaccaagaattcaattacgacagcttgggctacatccccattaagataatgctggataaaatctgtcgaaattcctagcaaagatttaactttcactttcaatcctgtttcttctaaaaattcacgcacacatgtctcttgagcagattctccaaattccattgctccacctggcagaccccatgacttaaaatctgaccttttctgcaacaaaatttcatcttgatcgttaactaaaactccaccagcaaaatttaaaattagtggttcatggcctacctttttacgcaagtttttaatgtaatcttgttccatctatttcttctcaatcgtgtctaacattgtctctccaatatgtctgaaagccagatcctcaattttttcagtatagttaaaaatgcccactgcagtagtaaaaatcaaatattgttttgttaagtcagataagtgataattaggattctcacttgaataccccgccagaaatgattgaatcaatccttcatttaaaccaaagtcttggtaaaacagttttataaaatcttgatatactggccctaaacgtgctttttcaaagtcaataagtgctagcttactatcaacatatttatagtttctaaggcccacatcaccatgcaagacaaattttgaatgttgagataattctaacttaatttcattttcataaggtagaaatttactagtaagtttcttcaatcttcttttgtatgaactttctttaaaagaatctatttcagccagataatcatcaaactgtccgttaacaagtttaattcttataaatggtttcacctttaaatgatactctcctaatacttgtcccatctcaaaagccagattcgaatcaatcttttctcctatatcttttggtgagcaatcttttaacactaaaataaacgtattattaagagaaaaaccgtctaaaactcgatcatttaactgatttgtaaccatcttttcagtgtaataaccttgctcttttgcaaattgttttacaaaaatcgattgccgatataaattactatagccaacaaaagtgctgttaagtgattcatgattaattgcgtgtaagttagatttcaaccgcttatttaattgatcaatgattgttgacatagccaatatccttcataatcttttcaatttcttgccttaaagttgtttgactagaaaacctagtttcagaaataaaatttatataatctttttctttccaccacaaacgcatttgtttttctctaaaagaactaatgtgcctttgttgatgccgcaatattgtttcttcaaaaggaatattaaaatagtaggcaaaaatttcatcaccaaaaagttgttgagctaacttaaacaagggttcataccattccgcattcagaattccttctaaaattacgtaattacaatattgatagccatattgaaggaggtctttaaataatggcaaccctaaagtgttttttccatccttaactcgcagcatatctcgtctaactgtatcttgcgaaataagtaaggtatttcgtggcaagcgattatggatttccctggcaagagtagtttttccactaccagaattacctctgatgataattaatttaggcaaaacaatcacttctttcttaaacgtaaatttgctaagttattccttctgctttatcaacggaattattaataaaacaatgctgaagtaagctgctgatacaaaaaacattacttttaaatttccagcccacttcataattgcgttacttacaaataaagaaagactgactaaaatttcagcaataaatgaaactgtcgaaagcatagtggatttgttgctttctccataaattgcttcattactagtagcagaaatctgtcctgacatcatccccattaataattcaattaatagaaaaagggtcaacaacaaatatttattttctataattccactcaaaacaaacaccaaaatcatgcacactgcatttaatatcgtgatacttcttgaactagcaaatgttgatatcctattaaatatgagtgagcctaaaataagtgcacacataaacaaggtatagacaagagataagttaaagcctaatttttcaacgtagataatcgaccaatatattagaataaattgcgttccacaatcatatccaacattcagcaacaacaatatccagaaatttcttttttaaagaaactagcaatatttttaatattatttttccgcttatgtgatgccttattatccgaaaaagataaaaactgtatcatgaaaaaaataaacgcaggatataatcctaagccaatcaatgcaaaccaaactggtgcagtatctgtaattgcaaagagcccagtgccaatatttccacctattaaggtggttaaatttaggatgataacttgcatccccattaatttgctattcggagaaagatgattttgctcttgcaagtcagtcatataggcaatgagtgtcccagaattaagtgcaagtccaagtccatataagagttccgctaaagaaaagaacaaaaagtttctaaatagaattaggattaaaaaactactcgcaataactattgaagataaagatagaacttttagccttccaattctatctgctaaatatcctgctggtagcaaccctagcatgataccaatattttgaaaggattttattgaactaatattagcattcgggataccatttttagcatagaataatgaaaatattcctgacattgatgatcggaatagtgtaaacactgccgtaaaagttaaaaataaaactgcaattttaaagcttacactttttgatttcataatcatcaacctttcagtttctctatccttattcagcaacatctttcactatatttgcaatctctcgcgggtattcaaaatgaatatagtgatatgtccctaatgaaacaactttagaattttttgaagcatattcagaacgtttatattctttttgacgatactcttcagtaatcaacacactagtaatatcgtcatctaattttagatcgtttttccaataggaatcattttcaagagcagcttgggcattttgattatctttttcatcgaacttctgcacattttgctccgtagtatcccaaaagtctttattttcttccggagtaagaatatttgataaatcagctctaatttgatcttctaacttttccatatccttgcttttttcaatataagcagcttctttaggcggattcaaaattatttctctagtagttggttcaattccaacaaaagccttcaaattatttattttatctttcatcggcatcatataaacaccaccgatgctatgagctaaaataataactctttttgctttaaaggtattaataatacttgctaattcattagcttcatcagcgatggtatagccttttagcgatttaccactgaaaccactattcaaataatctggagcaaatatcccgtagttttctggtaaagaatctattatctttaaaaaagattgtgctgtatcaaagctgccaaagccattcaaacaaacaattaatggctcaccctttcgatacacaaaattaattttacctaattcagtttcaacatcttttcgttgcataaaattatccctttctattcaaactccgcttgccaatgtgaatcacgatatgccttaaagcacatttctacctgctcacgtgatcccttatcttcactcaactcgggtaaatcctctaacgcaaaataaccacttgcaatagtttcgtcgttttctttaaaacctccaccagctggcttacataagaaaaatactgtactaattccataaggatacatccctttatagtgcttattactatcatgaattgcaattagcttttcaaccgtaatatcaatgccagcctcttctttgatttctttaatcacattctctttaactgataaatttatctcacaccagccaccaggaatcgaccataagccatcgctttcttggaccagcaacattttattatctttaaaaatagctgcccgagttcctatcttaggagtttgatagcctacttcattacaaaatagattttttaccttctcaattggtaaatctgacttctcaaccatcatttcagctgaaatatctcgaatttcttgatacctctcaagatcaaaactatcttttccatatgttaatccagcttgcgctaagctttgaagacgcatagcccaatcaacaagtttatctgtcattattttcaccacctaaatcgagtactaacacaatttcttccccatctttttctccattcggaacaaacccagcttctttgtataatttttccgcccattcgtttccaggtacataggacaaatatatttttttaccttcgcctagaggctttgctcttatataatcaataagtttatttagtgcttttttgcccaatccttttccttggtatctttggtcaatcataaatcgccagatacaataattattacgagctacttttggtgctccgtcccaattgaatacattaaagttaatcatgataaaaccaactaatatatctttttcatacacagcaaaagtttcaactcgttcattttcattctgagtagcataagcttctaataaactaactgtattagtcgcaacatatgtcttttgatttgctttaacttgaagattgacaacatcccataaatttttgtttgttatcttcttaaattccatacctgttcctcctgattttactcgttcttcaatacaaagactttatgatcattttcatcatctttcatatattcaaatcctgcacgctgagccacatgttgactagctaagttatcttgagctgttcgtaaaattaaaaattctaaattcagctgtttaaaagcatactctactaaaaactcaaccgatttagtcataattcctaaatgctgagcatccccagaaagccaataacctacttcacctgatctttgattcaattcgtgcaaatcaatcattccactagggacaccctcaactaagataactaaattgaatgcctccccagcaaccatcttttcttgaaacattttaattgatgcagcttcatctcgggcagaaccgattttttcaacccactctaagtatttagaaaattcgacaaaattcttttgaagttgatcaaacagagaagcggcttgccagacttctggtaaaactaattcaatcttcttatttccagttgaaaaattatgtaaaacaaatgcgatatgtttcatatacgcagctcctcttctcttaacggttaaattacattaaattttacttaagtacatttaatatttcaagagtaaaatcataataattattcataaaaaataagcagagatccactaactaatctctgcttatcataataatatacttttattttattaaaaactcaccaactaattttaatacttcaggtctattttttccgttaaacatgtgaccctcatctggaattaaatggagctcacttttaggcaaaagtgtatgaaattttcttgaagcattaggtgacacgactttatctgctaagccatgaatcaataaagtttccctattataatgttccgctgtttgataaataggcaataattgagccgttctaaagtaagctcctcctacttcaaagccactaacattgacagtttcagggatatgcgttggatcataagtactaccctgacaaactccatctaaagcatcagacttaagagttgctgcaggagagagtaaagccaatttttcaataacatctcgataatatccagccagcattgacgctactactccaccttgggagtgtcccactaaatagatatgttttgccttaacagtattacgaacataatctaatatttttatcccatctaggatttcgctatagacagtcatatcttcaaatttaccatcactttttccgcatccatcaaagtcaaaacgaattgttgggaggccttgatcatttaagtagtgagagagagcatacaaaatcttgctgtcatcataacccaaatcacctttaaaaccatgcattaaaatagcaatcgtatcattttcaatcttatcggttccttcaagtaaaccatgtaagtttagaccatcacgtttaattgtagtctccattttcttcacctcaagttaattatagtttataacttaggttcagcgtaattgctaacgattaaatagacgagaaataaaaccttttttcttattttcttgctctttttgttcagttaacttttcaactgcttcttgcatcatcttattctgctcaacttgagctttaagtaaagcagccacattatcttgctgcttttcatctttatgtattcgttcatagtgctttctaattaatggctcaccaatgaacttatcaaacttgtcaatatcaagacgcattccattaccgtattgctcaattgcaataccgccttctcgtgggaacatattaaagtaattatctagagtttgattaatattctcatatccattggctttaaaatcattaaaaattgcttttgaaacatggaaatacttatcatctccatcagtaaacgcaatatgttcataatgatcatcaagaattaacattttccacgtaatacgattgcgatcaattttataatcgtagttagctcctaaaatattctttaagcgattataatagccatatttcttcaaaaggtttcctaagatttctttagttaagctcaaataatcttcaattagatttgcctcttcttcacctgtaagatgtactaaatgcttattgagttcagaaactacatagcgataaatatggtcattattatcattaattaacatattatagttaatttcttgttgatttgatggaagccatggagcttcaaaggataagtaatatacacgcttggtaatttcttcaagattgttaatttctttactacctgcattatggttcatcgcaaagatattaacattatgaattcctttaatagtattagaccattgcttaattgcattaagggccactttactatgtaaaaaattactattcaattcatcgacaatcatcggagaaataaaacgctgagaatgcaaataattatctaaaaatctaactgctttatcggttctagcaccattaccatcattaatttcagtgtattgcaaactatgagacttgtctccagtaaattttttaaaataatctcgtactaacaatgttttcccagtagttcctcggccaattaacaccatcgaaagaggaatctgatcagcactttttgaaaaattagatttacgataaatttcacgaattttccaaatcattggagcagtcatcagataaataaatgcagaaagtgcctggtgactttcatcttttaccttattcaatttaaagctttcaataattctaacaaaagtacgaacatcatcctcactaactatgtccgaattaacttcaagcgaatgaaataaattagtgttggtatcttcaacaataatattattatcttgataagcccaaactggtttaggatatagagtgctagcttttattacacggttttgagatggatcactaaagtcttgatagacaattttcttaacttcttcacggaccttttcttcatttcttcgtttattgcccttttccgtaaagagttgcttagctactttttgaacagtctcaggatggagctcataagtttcttcttttctatcagcatctttagtaatttttacaatgtcatccggattacttcaacaaatattttgttgaactttatctactacttcatctgcaataattgcagtaatttgctttttagttttaccatatagattattgataatttttctatctaagtaatcaacactatcttcttcgaaatttttcttaaaaagcttttgatgctcttcatagatttttaaatcctgtaaatcatttttcttaccttcatacatccaaagcatttcatgattctgttttaaagctttcttagtaagattcattgaaccattgaaaataatgaaatcagtattattttcaataatgaaatatttactatgaaaaagtttatccttagtgaatcttaaatttaaagtttgattttcaattcgatctaaaaagtctgaatcccgacttaaagacaatagctgctttactttattagagacatttaataattgatctaaattcttaccagttttctgatcttccatccctaaaattagatcaatctgtttaaagcgtggcaaaagctctttctctattattttaaaacttccaacaaaactaactcccttaaaagagtcatatccttcgaccaacttaaagaaatctggttgtttaagcattacattattctttaaatcataaattgttagcatatttatcccctttctttctatttttttcgcacatatgttcgcattttattacgtagaaattatatcatagtttttaagacgaaaaaataaactaagaataacttttcttagtttattattatctttaattatttttccacgaattaacaaaaaataacaactgcagttacaataccgattatcataattaatccaaaagtagttaatttactgaattttcttgttaataaaaggtaagctaatattatttgaatcagctctgcaccaatctgaattatattaaggtggactcggatactaaatatccaacaaatagtcacgatcgcaattattgcgataccataccattttaaagcgatattttgaaaccaatcttgaaaaataaaatatacgctggctaataaataagggacaagcatatgtacttctaattccatttatcttactccttttgtaaactccgttctgtctaatgactcttaagttaaaactatgatctgaaattatgtattactttacaaagatactttattttgtctaaaactcaccttttctctaaataaagctcacgtaaacgatctcttaattcaggtgtcacatccaacacatttttcaaatatgcatccatattatgatactgctcttcaattgtgagtgaatatcgtatcaaaaaaggaatcagaagccgagctcaagattcgcatattactcctaaaggtaaggttttcacctgtattttcaaactttttatcacgttctgctcgataagcagaaagaatggaattagacgctaagtaatcttgacgaattacttctaaatcaacacctaaaatatataaaacaaataaaactacaaaaccagtacgatcttttccttcggtacaatgaaaaatagttgctccattttctttttcagatagaatagttaaaacttgacgaactgtattttgatcatgcgctttaacaacatggtcgctataatgatcacacatcattttaaaagcggcatggggatcatgatggtataaatcatcttctcgtgataaatcttcaatcccacctaaagtcccttcttcttcagaaagaggcaagggaatatttttaacaccttcaatttgcggatcggggtggtctttcctttcactctttgatcgtaaatcaatgattgtcgttaaaccgtaattttttaaaaactgaatatcctcatcagacatgcgggtaagggttcccattctaataagtcggtgtgtctttatctttcttccatctaatcccactattccacccaaatctctgggattaaggatactattaactggcaataatgttgttgtcatgaatcatcctcattaattatcttctctatttctggcgcgattaaactttgttgaactttcatatctactggatgataggttgaatcaatacattcatcccaatacttaatatgttccttatctatataactttctgattcttcaacattctgaccattctcgccttggacagaataccagtaaaaatatgtataaccatcttcattcttttcactaaagacagtctcaacatacattttttcagcagccattgttttaactgtatcgacgtgatgctcatttaagaaattcatccactcttgggcttttctctctttacctttcttaatccgaaagcgagttaattcaatttgtgtcattttctatccttcaatcttttttccatcaatgtattttcgccttttattaatttccatctttttaagaatatcttcaccaagatcgcttcctaccatttctgaaattcctaaaagaaaaattgcaacatctgccaattcttcattgatgttctccggatcatcctttagccacgcctgaaaaagttcatttacttctccatataatagaagaagttcaaacttaatatcagtagtattaaaattatggtttttcttattttcaaggacagctttttgtaattttttagtgtcaataagcatttttaatccttcatttatacattttatctaattcaatcttcaacttttgctttagttcttcaagctctttatcattcaatacattctctgcactatacattttttctcgtggataccaccatactggccccttgccatggtagccatattctcctaaatctccgctcactcttggaaacaaatgccaatgcaaatgagaatcaccgtttcccagcaattcataattcattttttcacattcaaaagcttttgagactgcttcaccgactaacgacatttcttctaagaaagcttgcctttcagtcgaatctaactcatatagttcatttttatgttttttataaagaaaaagcgtgtagcctctaaaatactgattatcacccaataccacataacctgtttttaactctttcacaaagaatttattttcattatctttaatcatttcaattcgttcacaaattagacacatagattttccccatttcttgtttatctcaattccatcgtgtcctgtgaaaaagcgataggaaattcatcggaccacttttcagtaagtgtatttactctctcaaaaccaaatttcctgtataaagcttttgctcgttcattatcagtaaatacttctaatctaacgggtctctctaactcagttaaggcttttttaattaactcagtcgcaatccccttactttgataaattggatcaacataaataaaacttaactctctcggctgaaaaccaacaaatccacctaatactccatcctcaaacgctacataaattttacaagacaaaaaataatctaaatatggtgcatcccgtaatggtagaaaaacctcctccaaatcttcactctgaagttcttgttttcttgctctatccattactaagcacaactcattaaaatatttttgttcataagatttgatctctagactcatttttaacctaattctatttacattaattatttttttatttattattaatctaacataattttatatttttacaataacgaattggagatgattgaatgaaaaatagagttaaatatatccttgcattcgttttttcagttttttgcattggtctattgatctttgcagggtatttacaaattagcgaacatagatacaaaggcctcggttggtatgctttagctatcatagtcttacttattagtgcttttctttacttgagaaatgctattaaaaatactagtattgctgacttaaataatgcagaagacaatgatcctgatctaaagctgctagaaacaaaatcaaaagcaaaagcctttgatattatcagtaacaccagtttttggtgtggtcttgtattaatgatttatgcttcgagtcaattacatgaagatcccccgttttcatacattcttttagccatttctggtacaacaacagtagtttggctaatcacagtattagttcaactcttttatgttgttaaatatgagagacaagtagatgacactaaaaaataaatcattaattttaaaaccatttagcttacaataacgaattggggatgattgaatgaaaaatagaataaggtacattcttgcggctattgtttcaataattggtattggattattaatatcggtatcgtatttacaaatacaagctcacaattctagacaaattatttggtacataatagagattatcattttgctcagtgccgccttttattactttagaagcgcaattaaaaatactagcgatgataaaggtaataaagatgcttctaagttaaaaacaattgaaacaaattcaaaaataaaatcattagactttataagcaatctaagcttctggggtggcattctattaatgatctatgcctcacatcaattaaaagatgaccctcaattttcatatatactttttgctatttcaggcactttaacaataatttggttaattaccttagtagctcaacttttttatattgttaaatacgggagacaagtagatgacacagaaaaataaactattaactttatcttcctttaattcacagtatttaaaacatatttggcgagacggttttcaagatgaaaatcctgaatggactaaatggaatgcaccctattttaatgattatcatgcttatccttctttttctcagtttgaacatagtcccattactgactatctactaagcaattcttgtaaatgcatctgtttggatgaaaaaggcatcggaatggtttcaaaaaattggatagatgaagtaacccgctggcttgaaattggcatagttatttataatcccacctattggcatggtggaataggtggtcgagtactaaaaatatggatatctgaaatttttgaccaatatccagaattagagcatatcggattaactacttggagtggaaacccacgaatgatccatcttgctcaaaaactaggttttaaaaaagaagctcaaattaggaaagtgcgtttttataaagaaaaatactatgattgcatgaaatacggtattttgcgtgatgaatggattaattaaaaaaaggcagtgattttatctttgaattgctgcctttttctgatattaactttttagctattttatacctatcttctacattattaacaacctaatttattcgcaaaggcctcttagattcatcaaaaatgttttatcatgtgttataatgtggttaaacgtaatacatttgaggtgaaaattatgacaactactgtaagtttgagattaccggaagatttaaaaaaacaagcaactgatgtttttaacgaatatggtcttgattggtcatcagcaatgagaatgattttaacgcaagtagtaagcgaaaacgctataccagttaatttatcaagatattcagatatttctccaacaatgaaatctaacatagaaaagtcactccaagaatacaaaataggagattacaaaactgcagattcagtagatgaattatttgaggagcttgataaagattaatggcaaaaatcaacttcactcctcaatttaagcgagattacaagaagctcaaaagaaaacactacgataccaataagttgaaacatgttatcaatttattagttgaagaaaaatttgagattcttgctcaaaaatacgatgatcatcaattaaaaggttcattcaagtctatgcgtgcgttgcatgttgaacataataaagctggaaattgggttttagtatataaaattcataaaggtcaattagaattattaactattgacttaatttctactggatctcacaatcattcttatagaacttaaagcatttgaaaaatactctaactaaaaaactgatacatcaacgtttatttaacaatgatgtatcagtttttttgtcttctaaagaattaacaattaaaaccgtatttctacttatttccttactagttaacttctttattggtatatgatcatctgttgattttatatgtttacttcttctatttccatagcccaattctactccttattattaattgatattataaataactcctactaagctaaataatgccactccccaaaataaaccaacaaccaaacctaaaaagaaagttactggtccacttaatctcttgatcattaatttataactaaaaacaatcatcaatgattccgaaataattgcaacttcattgacatatgatttcaatccaactaaaggaaaaatcaaagctaagcttactgtaaatattatcgcacctacataccatttccatgatattttcttaaacaagtcttgaaagccccaaaacaaaaaggcaaataaatatggaataaaggtatgcatatcgatccaagtattcatcttttcacctatttctattaacaaactttttgattatattaataatttataacattttttgcagcactttttataattttattttcataatttaataaagtgtgctaatattattcttatcaaagaagaaacgactaaataagtcactttgatggggtctagaaaggtatattatgtctttaaagtttgctaacaaaaagaagctagcactttatgcccttttagcctgcataagtgcttgtggtaatgtcgtcatcgcttatgtcacaaagataatgttgaacagtgcgcaatatcatcgtggtacattaaatcaattaatttttattgctctttttggagctcttaccttaattatcattatgttcttaaattttgaatatcgttatttacgtttcgatattacacgggatattaatattaagctcaaggataaaactatcaactacttagtaagtcaacaagctgattcacaaaaagagggtcttaatttaatgactaatgacctaaagcaaattgagttacttaaaaccacaaacgaattaatgattatctctgagatagcagcttttattatttcaattgttgttggattattaaattcttggctattaacgataatttttgtaattactacaattattccaggacttattcagaaattatttgtaaaagatattcaaaataaagctagcatttgggaagaaaaaaatgccgaatacactcaagccgttaccgatgctattaatggttcgaaaacagcgatgctctatgatgttgaaatgccgcttgtttcttatgtaatcaaacaagcaaaacaaatggagaatgcattgcgttctttgaactatacccagggagctatttctactttaattattacaatagcagatatcttcagctttatcgttccatttttagttggggccattctaatgttcaatggccaaattggcgctggtacattagtcatgattgttcaattatctaatgactttattaatccaattacaatgatttttgatcagattaaccaaatacgttctactaaaccaatctgggacaaaatcgaaaaggcactacactcaaaaaatacatcccctacctcatcttttttatccttcaatcaattaaagattgaaaatttaacatatattgtgaatgataaatcaattttaaacgatgtatcctttacgcttgaaaagaacgaaaaaatattactaatggctccaagtggttttggtaaaactactctcttacgcttgttagtaggacagcttactccaacttctggttcaatcattatcgatgatcaacatatagaagataactggaacaaagcacatgaatatttcggttatatcaaccaaaagccatttatatttgatcggagtttactttttaacttaactttaggtaaaaaatattcaaaagatgaattaatgaatgcgattcaattagccggactgacagaattaattgacagcaaaggatttgactatcgagttggtcaaaatggtaataatctttctggaggacaaattcagagaattgaaattgctcgagctattttagctaaaagaccaattttacttgctgatgaagcaaccagtgcgttagataataaactttcattgcaaattcataaaacacttctaactaatcctaactttgcagtaattgaagtagcccataaaatttctgatcaagaaaagaaacttttcgataaaattattgatttaagtaaataaaatatagttaaaaaggtacagccactatatatagcgtcactgtacctttttactatattttcacttattttctaaccactttataacgattacgtctatcttctacttgttctttgtcggctggataaccaattggcacaagcacagtaggttcataaccctcatccattcccaattctttttgaagttcaggaaacttatttagtgcaaatactccacccattacataaactgatcctaaacctaaatctgccgcttctaccattacattctcagctgctacagaagcatccctttcaccaaattgactgtcctttttagtattaatcataaatatcagtggcgcattgtaacaagaattgtttgtattatcttctatctttttaagtagttctgggcttgtaatgacactaagttccatgacatccgtttgatgcatggcacaaggtgaagcttgaaacgcattaattagtttttgaattttttcttcatctattttttcatcagtatattttctaactgcttctctttcaaaaattgcgttcataattttctccttttaaggtgaaactatttaccatctatataagtttattttactctctcatagagaaattgtaataaaagatcattaattgaagcttttgatagttattttttcttcttctacctatctttgttagaatgacggtgaaagcaatattgtcaaagaaaggacgataattatggatattgaaaaagaggtatctaagccaatatttaaagccactttactagcaatttctctctttattatgatgccctctgttatttccccggctcttcctctaatcgaaaaggcattccctaatattcctcgtgttactgttgaattacttactactattcccaattttggagaaatatttggtcttttaataaatccttttctagttaaaaaaattggtagaaaaaatgtaattttagttggattagctcttgttggaatttgtggaacattaccagtaattattaatagtttttggctaatatttattctccgcatcttacttggtttagggattgggatttataactccttagccgtaagtttaattatgatgatttatgaaaatagtaaaactgaactcaatcgcctattagggttccaaaacattatgaacgatgtgggctacatcgcttctgcctttattatttgttatctagtaacattatcttggcacgctgttttctgggtatacattcttgccattcccgtattttttatgtttgaacactttattaaagttcctaagaaaactaagcattcttctggaaaacatttttctctttctaatataaaacaagcttttaatccaaacattatttaccttagtattcttaccctactaatttacattttctacatggctcttgcttacaaacttcctagtttcatagtagatttccatttaggaaatgaaagtatggcttcattaatgctagcaataattgctattactggtattccatgtggcatcgcatttaattggctttatactaaactacacaagtgggtatggattctatgtatgcttttaaatgcacttggattttacttaatcagtagtgcaagaaatacctatgtgctagtagtgggatgtattgtacttggagcaggttttggaattgtgatgccatacatctttaaggctatctccttaagtgttcctgaccaattaagtaatcttgctactacgttatgcttaattatgatggacattggtgctgtaatttctccatttgttatttcaatcatcgctaagaattcagataaagctctactttcctcagctatcttctttggaatcgtaaccttaattgaaattgctagaaatatgtacgccaatctaaaacataagtattaaatactttaatattaatctaaaaaatgctgctgaatctaaaggttattaggccttgatttagcagtattttttatcactcaaacttttaactaatcaaaatctacattatttggaaaatgattcaatctttcattttcaacaccgatttgattttcaatctcaagtaatcgattatatttctctactctttctgatcttgctggtgccccagatttcagttgacctgcattggtagcaactgtaaagtcagcaataaatgtatcacctgtttcaccggaacggtgagataccatcgttgtcatattgttctttctagctaaacgaattgtttcaagagtttctgtaatagtacctatttgattaagtttaattaaaatagagttacataatttatccttaatcgcttttctaacaagtttaggattggtgcatacattatcatccgcaacgacttgatgagtagagccaaatttagcagtaaatttttcaaagttctcccaatcgttttcatcaaaaggatcctcgcaagaaataatctctgggaattcttttaataatttatcataatattgaagcatttcttccccattccagatatgaccttcgaaatgatattttccatcttcagtattatagaaagaacttgctgcagcatcaaaagcaattgcaatgtcttttctaggtttataacctgctttaataatagcttttcgcagcatctttaaggcttcttcagaactattaaggtttggagcaaaaccaccttcatctcccaatccagtttcaaatccagcttcttcaattacagcttttaatgcatggtatgtgttaactatcttttcaaaaccatcacggaatgaatttttagcaacaggagtaatcataaattcttgaatatcaattccattatcagcatgcttccctccattaattacattatgaaaagtttgtggcatttctaactcacatcccccaagataacgatatagtggttcatcttttgacctagctgctgcgcgtgcaattgccattgaagtacctaagattgcattagctcctaatttagctttatttagggttccatctagtttaatcattgtccggtcaatctctgcctgattgtaaggactcaagcccttaagagcatcattgattggaccatttacatttgtaacagcttgagttactccctttccttgaagacggttgccgccatcccttaattcaacggcttctttttcacctgttgaagcgcccgaaggaacttcagctttagctactgtcccgtcagataaataagcatgaacttctacagttggattgcctcttgaatcaaaaatctctaatgctctaactttttctacataaacagtcatttcaaatacctcctgatatacaaaaaagagcaaaataaatacgacccctaccacccgctactcaaaaatagtttgtaggaagtagacgtcgttagattttgctcagtttaattggtgaacgtcatcacctattcaatttacactttcatcataccagcattctttttaaatgcaagagataatacaaaataattccacttatcgtcaatctttaactaaatgaatttcacgatcaaataatgcacgcatctcttgattaaaattatgtgctataaaaataattgtctcttttcccttaactaaattctttaaaatattcatggttgccttttgatctatcgcactagttccttcatcaatcaaaattatgtcacttccatgtactttagcccgggctagaacaattttttgtctctgaccgcccgaaatatttagtttatctagatttaattgatgctctaatccttccttgaatttagaaatatcattagcgaaattaacctctttgattataggctctacttgagaatttaattttgaattaaacatagtaatgttttcttcaatcgttccaggaaatagatttggatcttgtggaatatagccaatcttcgacatatcaggattaatttcttttccatctttatctttaaaaataattgatccttgtgtcggttttattgaacctaagatcaatttaaacaaggtagatttcccagctccggaatccccagttaacaaaattttttctccagattttatttgaatatcaggaaaacttaacttctcaccatttggaaaagctaaagctaaattctcagtagaaattagagctggctttttcttctgaatatttgaattattctgtagtggtgcagaatcaccactaatttggtccattagttcttcagaagatttcataaagctcaatgcttggatcatttgttgcaagccaatggaaatattagctgcaaaattttgtactgacatgattgcaccaaaaagtacttgtccttgagtgatcatgtatccagtcagagaaagaaggattaattgtcctattgagttacataatccatttattacaattagttcttgctgggtacccgtttgatgaacatgcgctttttcaatcttattagctgcctggctctgaacttgaaatagcttggcaccagcaaaatatctacgtaattcttcaactccagaaaaccatttttccaacacatctaaataatgtttattttgaacagaaacattggttgtcgccttttccatctttttctgaacaagtttaggaatatagtaagatgcaatatcaatcaaaatacttacaacaaaaatttgccaatgaattgtgagtaaggcaactaaagcaccaacaaacattgttccataaaaaggaacgataatgtaccaatcaaaataattttctcttaccatctcaaggtcgttagtcattcgattttgagccgcagctattttgtgatacttattgtccttaaagtaatgactagcaagattattacgaatttttttattatattcctcttcttgaatgcgagtaacaaactgaatgtaataaattaagccttgggctgctaaatataagactccgatagcaagacttgtccataacactcccatccagtttttattcttgatgaaagttaaccaatacatttggacatatcctgcaccaattgcgcccaatccagaaataatggataaaaaattgatataaataaatctaaggtagtttgtcttgataaatcccttaaagctcatccctaatcacctccatttttcaagctgatttttcgatcaaacaggttctctagctcatcattaaaattatgggcaatcatgacaatagtagtttcctgatcaagtaaattttccaaaattttctttgttgccttactgtcaattgcacttgttccctcatcaataaagagccattttgatccggctaaaattgctcttgccaaaacgattttttgcttttgtcctcctgatagatttccttcatctaaattaatttcatgctttaaaccagctgggatttttttaagatcattttcaaactcaacttgtttaactactctttttactttctcatcaagctttgaattgaacattgtcatattattttcaatagtatcaggaaaaagagtattatcttgtgctacatatccaagttcatcccgattgagtttaatttctttaccattcttatcttcaaaaatcacttggcccctagttggtgataatttacctaagatcagcttaaataaagtcgattttccactaccactatcgcctattactaaaactttttcaccactttttaatagttaaatctggataagaaataagttcaccattcttaaattgatgctgtaggccctttatctgtaatttagctacttttttatcttgatgctcattttgtaaaggtgcgctcgcgccttctaaggaggttattttttcatttaatttctttgatgatttaattagattccactgagcagcaaattgtgcagtcccattcataactgttgaacaaaattgaattgttgtaataacggcaccaaagactatttgcccattaaagtataaatatgcagccagaatcatcaagattatctgtccacctatattaacaatagaggtagctaagtcggcaatagcaatagttgcaccttggtgaatagcagcctttttataattatcagcagtttgattcatggagtcagaataaattctaaaactactatatcttcttaattcatctaagccattaatccagtttgaaatcgcttttaaaagtttttcatttcttttagtgacttcaatcgtggcatttgaactcatattttcaaatgcctttggcaacaaaagtgaaactaaagttaggataagcgttaataaaactaagctccaattgtaagaaaataacactactattgaaaaaataaccattaacccatctaagaaggcagctttaattggctttaaatagtttctagttaattgatccaagttagcagctaaattattttgaactgatgctgtatcatcaatttgcttcttaaacaaatataagctaatcttttttcttatttgatgtaagtaaccttgactctgtttactgtacaagtagtccgaacccgaacccaataataaccggcaaatatcacagagccttgataaagcaataaagattacaaagcctaaaaaattcaaattctttaaattattaaatgccggtgtcatcaaatactgagaaagggtatctattacagcagcaagtattatcattaacaaaattagaataaagcgacctttatttattctaaatattccgcttagcttcatccttaacctctccttttaatcttttatttatattttaatattactgcgcaggttttaatttacaagctatttttattaagtggtcaaaaagataaactaagatgcaaaattatacaagttaagtggcatagatcgccaagtacgtgcattttcactgaaaaaactatagtagtattttttatgcttacataaagttattgcttaaaagttactatcgatacaacaaaaatgattaaataatctttcatttttacttaaagtattagataatatcattaaattcaattaatggaggctatagggatgacgtatgtttttataggagtaattattttattaattcttatctattttttatgtggtttgcgaatcgtaccgcaaaattatgtcggtttagtcgaaacgttaggtaaatactctaggacggttaaagcgggtttagtttttatttggccaatttttcaaagcttgagaaaggtaagcttagctttgcagcctttagaaatttctaaatatcgtattatcactaaggataatgctgaaatcacaaccagcctaaccttaaactatcttgtcactgatgcatacaagtatttttacaacaatactgactccgttgaatcgatggtgcaattaattcgtggtcatttacgtgatattatcggacgaatggaattgaatgaagcattgggttcaactagtgaaatcaatgcccaactatcaaaagcaattggcgatttaactgatatttatggaattcaagtagttcgtgttaatgtggatgaattgcttcctagcccagaaattcaaaaggccatggataagcagttaactgctgaccgtgaaaaaactgccgctattgctcgtgcggaaggtgaagctagaaatattgaattaactactaaagctaagaatgatgcattggttgccactgctaaagcaaatgccgaagctgtaaaaactcaagcagatgcagatgcttatcgaattgataaattacaacaagctcttgataaagccggcgatggttatttcagaaatcaaagcctagatagttttaaccaactagcacaaggacctaacaatttagttgtattagataaagatgaaatcactgatttaggtaaaatcccagctgctaaaaagatttgggatcaaagtgaaaattaatacgaacactaaaaaacttctaccattaaaaagtagaagtttttttgctctattctaaattgctgtccattttttgtgaaagaactgctactaaacggctattagatctaacaatataaattacttcatcatcactaacttggtctaagtatttcgttagatttgctctaaaatcactttgagttaatactaacggcataaatcttcctctttaatatgcataatatagctaattcatcagcaatatcgggtctataccctttaaaacttaagtaaacgaactatattttctgtagttctagccacattacttggtccatttttcaaagcagttgaaagatcacacgctccgggaataattccaaaaattgcagtgaagccttcactatataaactatcaattccttcccccagatagcctgctaatgagataactggcttatgatactttttacctaatttagcaactccatatggtgtttttccaaatttagtttgaaaatctgtgccaccttctccagtaaagacatagtcagtatccctaattttttcttctagtttggttacttcaattgcaagatctactccttgcctcatttcacaagtagtaaaagccattaaaccagctcctaaacctcccgctgctccagcgcctgacactgaggcaacatctttattcaaatcacgcttaacaattttagcgtagtgctgtaaattattttcaagtttttcaaccatttctggtgtggcacctttttgcagtccaaaaactcttgatgcaccctctttaccaattaatggattagtaacatcacttgctaaaatgatttttacatcttgcaatcttgaatctaagttagaaatatcaattttgtctagtttatctaaatttccgccaccaaaaggaatttgatgattgttttgatcaagtagttttgctcctaaagcttgagccatgccgctaccgccatcattagtgctgctgccgcctaatccaataataatttctttaacattgtgatctaaggcatccctaatcaattcaccagtaccaaaagtagtggttatcattggattacgcttcttcttttctactatctctaagccacttgccttagccatttcaattacagcagttgtcccattacctagaattccataatatgcacttatcttatttccaagcggacctgtaacttcaactataactctttgaccatgtgtcgcatctactaaagaattaactgttccttctccaccatctgccataggtactttaatcacttcagcagctgaatcagctttttttattcccttttccatcgcatcacagacttcttttgctgtcatactttccttaaatgaatcaggggctactacatattttgtcattattaagtcctctatttttattctctatgtttattctattatttttcactgtataatacacttaaagaatagtacattatgttttaactataagcgtaaaaaaatgaaaatcggacttattcaaggaacctcacaaaaagaaaaaaagatattggagcattacatcaaacaagccatctcacctgacgatgaattaatcaatttcggaatttatcaagacaggactactactttatcttatgtacaaatttcactagcaattgctttattgattaatagtagagcgcttgatttcgttgttactggatgcagttcaggacaaggaatgatgcttgcatgcaatacgttcccgaatattcactgcggctacatccctaccccacaagacgcctatctatttagccatattaatgacgataatgttgtttctttccctctcggcctaaactggggctggagcggtgaaattaatttttcagaaactatgaaggctctttttactaaaccttggggtaaaggatatcttacgggggaagcaaaacgtaaaataaaaaatactaaagaagtgaaagagcttaaccagctaactaaaaaactatgatttcttttcttcctgatctaaatcccgaactccttattccagttcttaattatgatcctgtttttgattttattgtaaaaaatggaacagatcacgaattaattgacacacttagaaaaatcaaaagtgaatatagtaaataatacttctaccctagactaaagcagaagtcttattttcatacggataaacatgcctagaatctgattgaaactctttcacagaaattatcttatttgcttcatcaaatttaataattgatacaccatcaaactcactaattctactcttataattacatttaaaataccattcaacaaaagctatctccttatcaatccaaatattcttaattggccattccaatacttgcccattcttattccaatctttataccaagctataatttcagctttatttctatagattggcccataacattcactataactagcatttttattgaaagtatcttcaaaatcttcaaagtttggaacaatccacgagttaaaatatctttttattatttgctctttactcttcattgtcatgcccttctatttttcaaaggattatagaaaaaggcagaaataaatttccacctttaacatcctatctttatttaactttaatcgccttactataatcaagtccctgcaacatctttgcaaaattaggacgcttagtctgcttatccattacttcacgtaagcctggcgttaaagcttgctctttttcttcttcatctgacaactcagtaattactttatctcctttacctgcaaccacttttgccgcaaaattagcatcaattatttgggccctcccagcagctactaaatcagtgtattttaaggcatcttcagctgtttcttgactcattacgtctcccacaataattaattttgtctcttttccaattaccggtttaaataatgctgcaaatgttttatcagagtctttcggttttgccttatagtccggtaatgataaatgaatatagtcaaagtcaaaattatttgttaaatcattaattaattttgttgattcgtgccaggtataacctacattacctggattaatttcttctggactaatccgataaccaataataaagtcctgtggagcatactttctcacaactttgaaaacttctttagccacagttaatgggaatgcttcgtaatctccccacttatcttgacgatgatttgaaaagcgagaaaagaactgttgaattaaataatgattggcaccgtgaatctctactccatcaaaaccagcttcaattgctcgcttagtcgctctaccaaaatctttaacaacttgttctacttgttcagtagtgaaagcctgaactccataaggtaaaaatggataattggcactatctggagcatatactggcaaccctaaatgtgcacgataatttgcttctcgtcctgtatgggcaatttgaagtagggccttattccctcctgatttcatcgtttttgccatcttagtcaaaccaggtaaaaacttatggtaaaaacttatcatcataaacggctaattgtgttctattatccgcccaagtgattgcaggtccacctgctgggctcacataattatattctgaaattactaaacctgcagaatttgcacgtgctttccaataagaaattgtatcttcactaaccatgccatttaacccactgttggtaagcatcggtggttgcaccattcgattattaataactgcaccatgtttaaaagttactttgtcggataattttttcataacaatgacactttctataatcttcttactttttattagtttatgattatagtatagtgctaatttgttcttacgtaaagtaagttatccaattattcgaatttcaaaacttcatcaactggatatctaactgacttaagttcttctacatttttatctggttttccaatagcaatccccattactggaacatactgctctggatcaagtcccattacacttgcagctttctttgcatcataaccagccattgcatttgtttcatatccatgtgctctagcaattagcatcaactgcattgcagcaagtgaagaatcaaccattgcatccgcagtaagcattgttttatctgcatgctcatataatggtaaaaatgtattataaactttatctagttcttcttttgagattctcttttctgcatacatttgatcccataatgcacggtacttcttaaaggctaaagtgttaccaaaaatctgaataactgcacttgatgtatcaatttgcggattattaaaggacatgtaaaattcatgtagtttcttcttacctttatcagtatccactactacaaattgccatgcttgtaagttacatgcagaaggtgccgtagttgcttctttaactatctctcttaattcagaccgagaaattttcacatttttatcaaaatgccgaaccgaatgacgattgagtaatacatcaccgaaattattgttttcaaattgtgccatatattttatcctcctatgtttattagcgcttacattgagtattatagtataaaatttatgatataaaaacgggatacaacatcttttaaaatgtatatccttcttctttttctattctgctattaataacaaagcttgataatctttccgtggtaaatgaatatatttatcattttcaacttcttgatcaaaatcttccactgtttcatcccaagcattaataagcttggcatgatatttctttccttttagcaaaaagcttaaaacttcaaactctggctgattttcgccaaaataaactaaccatttcttttcatctggtgttgaaccaactgctaattcccatgttggtccacttgtggcctgtggatttacccaatcaaagccattatcttttagtaagtcatataagaaattaattttcttttgactttcaccatataattttcctccatgagcccaccaaattggacgttttgtatgaggcttatcaatgtaagtttcaccatgagtacatcctcctccacgtaaaaccacacgccagaaattgtccatcatgcctttggcagtattgtcaccccagccaaattcaatattaccttcatagcgacattcatcatcgataaccggtttttgatattctttaatccattttggaattatgaaaacattgtcactttggatgcttaaatgtgtaatccaaggcttagtatgatcataccaattcttagttgtatctttatgttgaggtggatcatagaaattatgaatagattctaggtgttgtgatggatctttttcatgaacgaattcacctattcgatcccaatcttttaatggaatttgtcctactaagttcatcaaatcatattcatttgcaagtgcccaccatacatttttatatgaagcaagacgtgcaataacatactttaagtaccaaagattattttctaatcccatacgagcaaagccccaacggtcatagggactaaataaaattaaatcagcctctatgccaagtttgtctagtttatcaatgttattttccaaattttgaaaatactttggatttggtctcgtataatcaaaaccagtttcatgagcatcaaaaacccaatcatttgctccacgcttatatcttaaaaatccttcaaatggatatatttctggttcctcttcattatatgaatagctcttaggaaatacgagcattctaattttattgaaattattattctttaacgtttctagtgtttcttcttgaacctcttttggttgtacagtccatgcataagctgtagttccaaaaggaatataactactaccgtccgcataagcaaaatgagttttgcctgctaccctaaccggtccatgattatccttgcttgccttagttactgtaaaattatcatttttttcatctaattctggaacgttcgagtgtgtcgtaacagtatattccccctcaacttcgggcatgtagcgaattttatattttccatctccatcgtagaatccatcaactgtaatcgaatgattatttctatcaaaagttgcacttaattcaacatctcgaaatggatttccatcagtcggtccatccaatgttaattcatatcttttccacttttctacttctttcatttttattctccttcttatttaacagcctttgccgaagtttttttagtgtttcttgaaaccgcaagtactacaaataccaaggcaattactcctaaaatacctgcgctaattctcatttgatcaaccgcagtagacaacccagtcattccactcaataaagctattacatatggtgatgcaaatgcacctaaattgttacaaatctgagcaattgaaataattaagttactaatggaactgtctacttcacttaaaatactgtcgtaaacatacggaataattaagcttgaaatcatcatcaacaataaaccaataaagaaaatagtcatattaggggcttgtgaacacacaataaatccaactgtacctaaagaaattgcgactactggagtaaaattctttagtactttgaaaatacgagcgtatgccatagaaattagagctccaaccagacccgcaatagcaatttcggtagacaacatcccctgatttgccaaatgattttgttgaataaccagagctgatgctgttgcttcaaccataaatgccgaaaagtataaaaatagcattaagaacgcaacataaatacttgccggaatttttgcatgcttagatctctgtttctgttctttagtagatgatttttcaagagtagtttctttttccatctttggggtgtaacccatcatgaataaaatcaaaaatggaataataaataggaagtaaagaaaagttgcttgccacttaattcccaacaaaaggccagctacaaaagtcattgaactgtttcctaaagttcccatagcaccttgaatgccaattaaagttttttgttcttctccactaaaacagtctccaattaacgaaaccgctagtgatgtaaataaaccaatgccagcaccaaccagtaatctactagcaacaataattgcaaaattactaataaaaaacggtattaaaccaccaactattgtcgtaatcatcccaataataactgtattttcttttaccaacccatttaattactgcattactaaataaaatgaaaagcataatagtaaaagatggtaaagtgaagagagcttgtactgaagttaaagattgattcggaaaggacttagcaatcaaaggaatagctgctagattggagccagctacctgcaagaaaagtgatattccaagaattccgacttttaatttccaattatgtttattatcttgctttattttttcaacattcattgtttttcctccttattttttacttgtttttctcacatctctataatattatgtaaccggttacattacaataagcaattacttaactagcactaaactaatatttattattacttgcgctataatagctgctgtaacccagtattttcaaaataaggatttaaaaatatgaccattagagatattgctaaattagctaacgtatctgtcgctaccgtatctcgaatcatcaataattcaggaaaagtaagcgataagacacgattaaaggtaaacaagataattgaagagacaaactatcatcctaatcaagtagctagaactttatatcaaaagcgttcaaaaatgattggaattattattccttttgctgaaaacatcttctacagtcgaattattaatggaattcaatctgttttgcagccagcaggctacacatgtttgatatctttcagcgtaggttcaaacaataaaaagtatcaagcggccatcaataatttccttcaaaataatattgacggtatcatttcttctgcctttgaaatgaatgagaatatttgtcgtattccgcttgtgatgtatgatagtgcaaacatttctgacgatattattcgtatagcttccgataatgctaaaggtgggaaggaaagcgtgaagttaatctctactgccaaaagagctgtcttaattcaacatcttcctttaagcttgccaactgttaaagaaagagtcacaagtattattaatgaattaaaaaagaggcacttgacctatactttacaagaaattagtgaacacgacacttacaaattagtcgctgaaaaagctcttcataatattcagacttacgatgctatcattacaattaacgatatctatgcagcccatattttaaaattagctagaaaaatgaatctaagagtaccagctgactttcaattagttggctatgataatactgaaatgtctgagcttacttcacctactctttcaacgattgaccaacaacctgaattaattggcaaaactgctgctaaaagattgcttgcattgattgatggtaaaagttctactgaaaatagtgtgatagatattaaaactgtaaaaagagagtcaacaaaataagacttggcaaactgccaagtcttattacagatgatattgttttaatagttttcgtgaactcttatgcttgagtagcattatctggaatttctacttcttgatcaacggttgccattaaaatttgatcttcaaatcttactgaatctccatttttcttttcaataataatatcatcaaaattattagcattcgttacaataattggaactactgtgtcatatccagctgccttaattttatctacatcgaatgtctcaagtaagtcaccttgtttaactttttgacctacttcaacttttacctcgaaatattttcctttcaaatttaccgtattaatacctaaatgaatcaacaattcaactccattgtctgactttaatccaatagcatgtttagttggaaaaacagaaactacttcaccatcaaatggcgcatgaatttcatcattatttggttgaacagcaattcctttaccaatagtaccagccgaaaaaactgggtcatcgacattttttaattcaagtgcagtaccctgaactggggatgcaattccttgatctttgaattcaactcttttaactttaaaatctttctttgaagtagtagagacaattttatcgccccaaattagagtactgataaaagcaattccaaaagcgacaagtaaagatagacaaaatcccataaagctaccattaattccagctttttgatcaataaacattggaattccaaaaataccaccactagcaaagcctccaaacatttttgcatttgaaaaagcagcgattgctccaccaaatgctgatccgattgatccaagaataaaggattttttatgtggtaatgtaactccgtaaattattggttctgttactcccaaaaaaccagaaataacggctggccaaccaatttccttaaatttagaatctttagcctttagaactaaagccaatgcagccccagtttgtccaaaaactgtacaatataacatcgcatcaataggatcaaaaccacgagttgctatattgtttaaaaaaataggtataaaggcccaatgtagtcctagtaacactactgcttgccaaataccagctaaaataaacccagctacaactcttgcatgagcataaatccaaagaatactatatgtcaattcttcactagcccaagaagttgctggtcctacgactaagaaagttaaaggaacagcaatcattaaagttattaaaggcgtgaagataagctttaatgatgaaggtagatagttgtttaaaaacttatacagaattgatgctagccataccgcaataattgctggaattagcgtttgggtataattcatcaaaataacaggaatattaaagaattgaatgctttgcttcatctgatatgcctggactaaagatggatagcagagtgctgcccctataattgctccaacatattcatttattttaaatgttctagcagttgaaaagcctatcatcacgggtaaaaagtaaaataatgcatcccctgcagcataaagaattaaatatgtgccactctttgtatttaatacatgtaaaacaaccaagagcgttaaaaatccttttaatacacctgcagctgctaagactcctaaaaatggtgtaaaaatagttgttaataattttataaagcgattaactatatttttatctttatttgtattttctttatgatcctgactcaatcctaaaagtggaattacttgatcataaacatctgctacgttgtttccaataataacttgatattgaccacctgcatgagcaacgcccattactccttttaattgcttaattgcattatcatcagctttgctttcatcttttaatttaaaacgtagtctagtcgcacaatgaactaaactaattacattatctttaccaccaactagcttgactatttcttcagctagttttttatctttttcatctactttagacattttcttttctcctccacttatatttttctgctttaataagtgaaccaatgcatcataataaagctctacatcttgacctaaaaggatttgtaactgtccatcttcaaactcactttctgaaattgctggaatcaactttagttttggatagtttactttctttgaatcttttaaatagaaccttagccttgaaatacagttgaatacttcattaatattttctgctccaccaactgcaaccaaaattttttccgctacttctttataactgttattcatttacattacctatctgcaaccgcaatatgatgaatatggatcgttaagtacataatttcatcttgcggtactttataatcaaacttttgcatcacaattcctgcgattctttgtgaaattaaatattccttatgatagcggtgaacaaccatgctataaagttctttatcaacactagattcttggatttgcttttttgaaattctctgagcaaaaaattttagatgagttactaaccgataataagcaactgattttgaactaatttctatatttaacatttcactaataatatctaaaagcctattaattaattcaattgttccggctgtatgttcaagtgagtttccttcttcagcagtaattaaatgcattgcaatattagttgcctcatcttctggaaattttaaattttcacttttttctaaataataaaggacccgctttcctaattgaaactcatccggatatgtttgcatcgtttcaattgttaaacgattctgaatcggcattcccttctttatcctttcaactgcaaactgcaaatggtctggcaatgataaataaatatcgtcgcttaactttttacctgaacttgcaattgcttctgaaataatttgatcagataattcaatatattttggatcaatgctagctagcatttcactcattgagttagtatctttttcattttttggataaaatactttttcaactctctcttcaccaataacttcacctgcctttttatgaaaggcaattccatttcctaaagctactaatgtttgcttatgcttatctgtagcaacaacagcgttattgttaagaactcttttaattagaaacatataatttacctttcaataaaaaatggcaagactcaataaacctaacttaaaataatttagatttatttggtcttgccaacttaatgtaacaatccgatttcttattcagttataagcatagcatttaatgtaaacgattgcaataagtgctacattagtttagcttagtttagttgcttatctataattatgagttcatcttctagcactggtagcattttaaggacattattttctacttgaccttctaaaatacttctattatttaaatcaataactttacaattatttatatgtaaatctaatttattaaaatctaaatttccagctgttggtaaataaattaagatataattctcactttccgcgcctctaattgctttacttacatcaatattaagcggttttaaaccattaggagcaaatttagttaaaatggctttcagaaatcctaaatccttagcaccacgaaaagttaaacaggtcctccagtcgtatggtacaagttgaacgttaaaatttttctctaacttctgctcaggatgactaatatctttccaaggccatattccaaaactaccataacctaggcctgcatcagctcccgataaaactgctcgccaagcagcctttcgtacatcgaatgcattatagcgtttaggttctggcgaatgcatttgggtcaagccttcataacaaagttcggtatcaataatcggtccctgataattttgtttttcacgtaaagctaatggaatagtataggcagttttttgaccgctataaccatgaccagattgataactataaaaactaacttgcttaacaaattcttctggcaaatcatgactctctccattaatgtgaaaagtgtatatgccagctggatctacacttttggcactctctagcacttcttgataatacttaattgccgtttggcgattttgtctttcattattagtgaatcccacatccccacttacaaaccaaattggattaaatcttttaaatttattaactacgtaagtaacataaggtttaatgcaatcaaatggcattaaattattttgagcaaggtgaagattatcaatccaattatctggaatgaaattgctccagagtaaaaccagtgctggaaccatgttgcgctttttcatctcttccagcattttaactgcattatcaaaatactcctcgtttatcttagtaaaatcatattcatatgatccatccgggtgctctacgactgtgaatggttctcgtccttttaatggtttactagaatcccattggcgtaatatattaatttgaatagcattaaatccttcagattttctcatatcaagataatatcgccaatctggcattgtaatactagtaaaggctccccaacaagtatcagctaaataaaatagtttttctccatttttatacaaatatttaccttttgttgataacattcttttacattcctctttaatacttagcttatttgtgtttctgctcatcatccaaaatactatctaaatcgccgtaccaataagctgcaaccttatccttaattggatcataataatctggacttacattaatgtacttacatgcttctgctaaaataggtacaacatcagctcgtacaccagccatatgatggatatatggtccataaacatattttgcttcaaatctattcaaatccttaaattggaaccaggcataggtcccttgttcatatggtccatcacaagttttagcattaccaattaacattgaatacttaccgtgatcaccatcaaatcgcactaaggtataggttccatctttagcttcaaaagcagctgagccaggatagtcaaaaacaaaatgtgaaggtggtaaaattggccgattttttgctgtttgaaaggcgaatgtacctaagtgctgtaataattcaccattctcattttcgggatggcgacagttaacatctgcaaatatggctcgttcatcacccaaagtagcactttctgctaataattcagaaatagcaccattaatatctgtctcacaagttacgggcatgccttcggtttgaagtagtgcttcagaagcataaggtaaaataccgatttccctttgcaactcagtccaacattgaattgtacctgcattgcaaccatattccttcatcttatcttgcatagcaagtttcaaagcagctactttggtgaaatcttcatctttaattttaatatcagcccaattacgataggtttcttttgtttcctcaattctagaatcctttttgtcaattaactcatacatataagaagttaactctcctaaaggaattggtgaaagttgaataccaaacttttctaataactctccttcattaacgatcactgaccaaaagtcaaagggacgagtaccaatttgtaaaattcttgtattcttaaaagttttaactacattacatactttgataaaatcaatcatccctctactaaaagcaggatcgtcaatatcgctatttttaatgtaggtaaacgggacattaaagtgacgtaaaacttttccaatcgcaaataatccacactgtgtatcccttctacgtgagccgtcgggagctggagcttcatcttttggaccccaaagtaataccgggacattaagtttagcagctaatcttgccacttcatactcagtaccaaaattctcattagcaatgaacaacccatcaatttttgctttcttgaatttctcagtaatcttttctaatccatcatcgtcgtacagaagtccgtcatcatttacttctttaatgtcaacataattgacacctagttcatctaatttttcacgtgttttatttgcaaattcaattgctgctgttgcagaaaaaatgtttcttcttgttggtgcaaagccaatcttaatttgttttaaactatcataattagtcatactcattacctctcaaatttatgtattcgcttacacaaattacaatagctagtatttcctaacacatcaatagttaatttacttaattaaacttaactagctattttaatgattctcttacaattagttttgtcgagataaagcttttctggctaagccaatgcgtattacttactttttcttctagttgattaattgcctgtctaacgatttgttcaatcggaacgtgaattgttgttaattccggattaatcattgtatcctcaaaaatatcatcaaaacccatgattgccaattggtcagggattttaataccaattttggttaattctttaactaaacgtagagccatataatcatcttcacaaaaaattgcatgcggatactttttattcgaatagaaaaatttaggtaatgttcccctcaattcaactggatttaaactaaagacaaagtctggcggaatttcaagatttttttcttttagagcagttctaaaaccctctcttctcttcaaaaaattagtaattatccgatttgatgcaacataaccaatctgtgtgtaacctttttctataataaactttccagcattatatcctccttgaaagttatcaattgaaacaaagtctgcatctacatcttcaaaataattatcaataaagatagcattcttaattttagaatctaagaatagaatttgttttttatttaaatctgttgctagaacaatcgccgccttacttttctttagagcagtactattttcgatgtcttgtttcaaatttcgaatatttaaagtaacaatttgaacttgtccaccagatccaccaacattttgagaaagattagatactaatgaatcaaaaaacggtaaacttgcataacttcgattcattaaccctgtagtagtcttaataattactaagctaatgctagttaattttctcacaccgccctttttatgctttcttagtggttcatagcccatttcttctattactttaaaaatatgcttcctcgttttttcacttactcctgcttttccatttagtgcaaaagagacagccgcttttgatacacctgctttttctgcaatatcactcatctttaatttcattttttatttctttcttaaataaatttactaatctaaactaaactaattaaataattaatctatgttaactataaacatgataccctcattttgtaagcatttacaagataataaacaaattgaggtgtttctaatggatagtttaagtttaaagaaaaaagccgttcaattaaggaaaagaacatggcaactaatctatcgtcatcataacggtcacacaggttcagacctatcatgtactgatattttagttgctctctattatggcgttctcaaccaaactcccgatacttttgaagacaaaaactctgatacctatattcaaagtaaaggacatgcagtagaaatttggtacgaaattcttgctgacaaaggatatattgatcaagaagatttagatagacggtactccacttttaatagtccctacattggtcatccaactactgatgtaaaaggaatggaatttcatacaggctctcttggtcatggacttggtttaggcgttggcgttgctttagctgcaaaaatggatcatttaaagaaacgtacttttgttttaatgggtgatggtgaacaagcagaaggatctgtttgggaagctgctatggcagcaagtaactacagcttggacaatttaactgcaattattgaccacaatgacttacaaattactggtacaacggactcagttatgcgttctaatccacttagtaataaatatgaagcatttggttgggatgcgattgaagtaaacggtaacaatattgatgctttagtagatgttttaaataagccaaataacaccggaaaaccaagagttattattgctaacacagttaaaggtaaaggaattaccgttgcagaaaatcgggcagattggcatcacaaaataccgactaaagaagagtatcaagaaggattacaagaattagatacacagctggagggacttaacaatgactaaagaagaaaaactatctgccaatacagttatcgctgatacactagacaaagcaactaaagttgatcctaatttgttagttgtaacctgtgactcacgtggctctgcagggttagttaattttactaatgctcatcccgatcgcactgttgaaatgggaattgctgaacaaaatgcagttacagttgctgcaggtatggctcatgccggaaagcatccctttgttttctcaccagcagctttcctagcaatgagatcaattgaacaagtcaaagtggatgttgcatttaaccaaactaatgttaaattaattggtatttctggtggcaactcctacacttggctcggaacaacacatcattctttaaatgatgtagctattactcgtgctattcctaatcttgaagtctatcaaccatgtgatcaatatcagactagagcacttttcaattatctgcttacctcacctcgtccagcttacgttcggatcggtaaaagaaaacttgataatgtttatcacgaagattttaagtttgaacctggaaaagcaaaaattattcgcaaaggaaaagatgtttgtctaatttctgttggtgaaatgctttatttcactctccaagctgctgaaaaattagcaaaaaatggtattgatgctgaagttgttgatttagcatcaattaaacctttggatgctgaaatgcttgataaactagcacaggaatttaatcagatagttactgttgaagaacatgatctaatcaatggaatcggtagtgctgtagcagttgaagtagctaaatttggacatgctaaattaacaattttaggatttcctgatgaaccagctattcaaggaacacaagatgaggtcttccactattatggcttggatagtgcaggtattgaaaaagcagttgaagacctcctcacgcattgaggcatttcttatgactgaaaaatatattttagcaattgatcaaagcacccaaggaactaaggtacttctaatcaatcatcagaatcaaattttcttcaaggcttccctttcccaccaacagctcattaatgaaaatggctgggtgagtcataatttaaatgaaataaaaaataatctaaaacagctatttaagcagattcttgaaaaagttgattctagacaacttgaagccgtcgctattaccaaccaacgtgaatcggcagctgcctggtctcgaagaactggtgaaccgctttgctatactattgtttggcaagataatcgctcagaacaattaatcaatcaaattacatatccagaattagctagaaaagtaaaaaacaaaactggtttagctctttctccatattttactggagccaaatggggttggatgcttttaaatgaacccagagtgattcaagcacatgctaacaatgacctctgcttaggaacaatagactcttggctagtttatcaactcactaatggcgaatcttttaagactgaagtttctaatgcttgtcgaactgagctaatgaatataaaaactggaacatgggatcaggatttaggtgaaatttttggtattgatctcaatgatcttcctaaaattgttgattcaaatgctaattttggtgaaactaatttatttggtctcattcctcataaaattcctattcttagcgttttaggtgattctcaagctgccttatttgctcatgggtgttttaatcctggtgactttaaagttacgtttggaactggttcttctgtgatgttaaatataggtaataatttaccaaaaaatattaataatcagcttaatacatctcttgcctggtcaattaatggtaaaaaatcttacgttcttgaaggaaatattaattatgcaggagcttgcgttacatggttaaaagacaagctacatttaattcacgatccgtctgatactactatgctggccctaaccgctaatccaaatgatcatactattttaattccggcttttgctggacttggcgctccttattggctccctaatatgaaagctgcatttgttaatatgacagctaccactggtaaaaaagaattagtacgtgccactctaaattcattagtttatcaaatcaatgatattctacaggcatttcatcacttttcttctcaagtgaacagtgaaattcatgctgatggtggaatgatacaaaataaatatttaatgcaatatttaagtaatatcactcaaaaaaatgtaaagattgctgaagtcgctgagttaagtgctctgggaactgcgatgaattcaatgcaacaatttgatgggatgcattattctaaaacttatattcctcgaatggacaaacatgcagcaaataagtattcaagtgaatggtcttcttggataaaaaaattatcataataaaaaacctagaactttcacataattgtgtcagtactaggttttttattattaccaaatagtaattctatcttcaggatctagccacattccatcttctggagttacattataagcttcgtaaaactcatcttgattttgaacaggaatattaactcttgttggttgcggtgcatgtacgtctgattgaacttctgctgtaattgattctggacgttgtttttgcatccagctcttcgcataagtttcaaagagatctttcatctccccgccttctgctttattagcagcaattgcacaagaaagaccacttaaatcggcaatgttttcagaaacaacttgcttaccatttaacttggctggtccatactgtaagccatcaaaaatatcagcaacggccttagtacgtttattaaactcagcaaagtctttcttagtccaccagttcttcatattacccttttcatcaaattgggccccattattatcaaaagcatgagaaacttcgtgaccaatagttgctccaattccaccatagttagctgcacgagattgttttgcatcataaaatggcgcttgcaaaattccagctgggaaagttaaatcattcttttgtgggtcatagcaagcattgtttagattaccgggcattgcccaaacgcttcgatcaggaacttgatttagcttttgcaagttgtctttaatcttttcttgattaataagagcttgattctcatatagactcttatttagatcaactactagtcggtcaaaaacggcctgattcttttctggataaccaattttgagttttaaagcttgcaatttaacaatagcttgtttcttagttgattcggaaagccagtcattatcttgaattctttcttcatagaccttcaacatattcttaatcatgctaattacatcatttttagcatcatcgccaaaataagctttaccgtaataaatcccaacaacttcatcaaaagccgcatttgctaaacgatatgcatgcttatcttgtgctggcatttcaggcaccccataaacagcttgtctaaatggaaaagctgcttctctaaagtcttgagataagtaattagctcccccattaataaacttaacaatcatccagctcttgatttcgtcaaattcactattatttaaaaattcattgatatgatcaaaataacgtggctctgcttcaattacttgatcaggtaattcaggtaaaagctgttttaagaaagcattgatgtcgaaattttcaaatttagcttcaaaatctgccaatttaactggattatagacagctgcatagtcagcccattcttcagtcgactttaaaactttggcaagttttttatcaaattcaatacccttacttgcccaagtctttgcttgttcttcctctactccagccattacaagtaacttaactgtttgcttttccaaagtagaaagcaatttttcagcatcatcactttgatatgcagtagtatctggcaaaaatgtacctggtccttctgcatataaggcattatgatcagtatccttcatatcttccattacaaaaatattgaatggtaagtcatatccttttgcaaacaagtcagcagcttgtttattaaattcttcaaagctatttaatgatgttaatttttctaaatcagctttgattggctctgcctgttctttatttcttttatcaaaatcaattgctaatttataaagattaattgcttttgcaaaatttggtatagtaggaatctcctttttcccgtcagcaaatttggcaaaatccttcatcaattgatcttcgattcgcatatctaaaatcaagttaattccggttgaagttctgtcagctggaatttttgcttttgaaagccattctgagttaacggctaagtaaagattatcttggggtctagtattaatatcaggcttagttaggtcacctgcacccccgcgaatattaaagtattttctcatctaattaccttccattgaaattataagattaattaaatgatatcatgattaaattaattttaaaatgtcattttttagaaactagaataatactttaaactttactatttggttcgatcttaaccttaaaatctttacgtgggattgcattatttttcacgtacggtttcttttcgtattcttatttcacgacccattttgttagacttgtaacttatgagtgcaagtacttgcttccctctttaatcgaaagcgcggccatgtcggaataatgatcattaataaatttttttacccaggcccggttagttttagagtaatcacgtaagacccaaccaattgccttattgatgaaaaattctgaactattcagattattttctaaaattttctctaacaattcagtgttcatcttattttttcgtaagagctgatgttcaattgccactcttcttacccaaaaatcattatcttttgaccaagcaagcatcaggtcatctactcttccatcccttaacccaatctttccaattggctttatcaaactatcaattgtatcccaccactgcttagactttacataataaaaaatatggtcaaggtcttcaaacgttagaaatctttctaatgaaattaaataatcacaaacgaaatattgtgcttctcgatgtgtatcggaccatgcttgatcaagaaaattccaatcaatttttttatttttcttttctactttgattaggtcatggtaacttttccgtctttcaggcgatttcaaaccataaaactcaaatttattccgtagatattttttcatttgtgtggctaactcgggatcactattttcaactaacttttgttttagttgttgatacttatctaattctttcacttcagtttccttacttgttaaaatacatatagtaatactagagggagaataatcatgaaaattttaattgttatcgatgattatttcaataaaagtaatgggatgtcaatctcaacgcagcgctttgttcacgaatttaaaaaaatgggtcaagatgtccgtatcctttcttccattgcaggcggagaaccagattactctcttccaataatgaccatcccaatttttaaaaatattattgctaaagaaggatttcattttgctaaacctagaaaagaaataatcaaagacgctattagatgggcagatttagtccacttagaggaccctttcccggtttgctggagcgcagctaaaattgccaaacagatgagaaagccaattacaggtacttttcatctttatcctgaaaatctaactgcttcggttccagttttagaccatgccagcatcaactctgcttttatgagattatttcgtgatactacttttaattactgtagctatttacaatgtccaacttcgaaagtcgaacagcgtttaaaaaaatataacttcaaatccaagttaatagttatctcgaatgggattagtgattattatttacaaaataatcagaaaacaacaacaactgatccctttacaatactttcaatcggccgtttttcaaatgaaaaggatcaaaagaccttaattaaagctatcggacgtagtaaatacaaagatagaatcaaattaattttagctgggaaaggacccttaaagaatgaatatatctccctttgccaaagactaaagatcaatgctcagtttggcttttattctagaaatgacttaaaacagatcatggatcaatccaatattgttgttcattgtgctaacgtggaagttgaagggatggcttgcatggaagcttttgcgactgggtgtgtacccataattgcccaaagtcctctctcttctaccagttcatatgctttaagtcctaacaatctttttcccgctggaagaagcgaaattttaactcaaagaattgattactggattaatcatcccaaagatttaaaagtcatgagcacaaattaccaaaattatgctaaatctcttacagttgaattttctgctaaaaaggtcctaacaatgatgaaaaatgctcaaaaaaattatatttcaaactaatattcaaacataaaaatatgtgttattcttatgttaagtctttcacaaaaaggaggaaccttttttaatgtccattaagaagttagaaaatagcagcgatcatgcaatggtagctgaagaagttaaaattttgaccaacttacttaacgagagtatacgtcaattaagtggggatgtgatttttaataaaattcaagatttaattaaaatctccgcccaaaaagactacgatgctcttgaagagcaaattgctagccttactaatcaagaaatgattgtcgttgcacgttattttgcaactttacctttattagttaatatttctgaagatgtagagttagctagtgaagttaacctactcaataatacggatcaagactatcttggtaaacttgaagatacgattgacttagtttctcaaaaagaaaatgcaagtgaaattcttaagcatgttaatgtagttcccgttttaactgctcaccctactcaagttcaaagaaaaactgtccttgaactaactgaccaaatccatggtttattacgtagttatcgtgaagttaaaaacggaactattaaccaagctgaatggactgaaaaactccgcgcttacattgagattttaatgcaaaccgatattattcgtagccacaaactacaggtttctaatgaaattacaaacgttttagcatactatcctaaggctttgattccagctatcactaaatttacagctcgctatcaagaattagctaaaaaacataatttaaatctatctggtgccaccccaattaccatgggaatgtggatcggaggcgatcgtgatggaaatccatatgttactgccgaaacattaaagttgagtgccactttgcaaagccaagtaatctttgaatactatattaaacagctaaacaagctctaccgcacgatttcaatgtctacttcttatatgaagccttcatccgctgttgaaaaattatcagatctctcaaatgatgattcaccatttagaacgaatgaaccatatcgtcgtgctttctactatattgagagccgtttacttcatactgaatatactcttttaggcacagctgataaaaatagttttgttaaaaaacgcgatttggaaaacttagacaaaattcctgtttacaagaatccacaagattttaaagctgatttaattacaattaaagaatcgctcgaagaagatcatgaccaagctgtagttagaagtttctttactgagctattagaagcaattgatatctttggtttccatttggcaacaattgatatgcgtcaagattctagtgtaaacgaagcttgtgttgctgaattactcaagagtgccggaatttgtgatgattatagtgacttaccagaaaaagataaggttaaagttttacttaatgagttaaacaatgatccacgtaatcttcacgctaacaacaagccaaaatctgaactgctccaaaaggaattaaatatctacaagactgctcgtcaactcaaggattgtattggtgaagatgtaattaaacaacacattatttctcatactgaaagtgtctctgatcttcttgaacaagcaatcatgcttaaagaatatgatcttttaaataatcaaggagctcgcatttaagttgtgccattatttgaaacagttgaagacttagaaaactctcgtgaaattatgaaagaatttctaaatcttgacattgttaaaaagtggcttgcttctcaaaataattaccaagaaattatgctgggctactctgactcaaataaagatggtggctacttagcttcttgctggaatctttataaggctcagaaagacttaactgcaatgggcaagaaattgggtgttaatattaccttcatgcacggccgtgggggaactgttggacgtggtggtggtccttcttatgaagccattactgctcaaccttttggctcaattaatgaccgtattcgaatgactgaacaaggtgaaatcattcaaaacaagtatggtaatcaagatactgcttactacaatttggaaatgctggcctcagctactatcgaccgtattgtttctaaacaaattgtaagtgaagatgatattggtggattccgttcctcaatggatgaaattgttttagacagtaataaagtttaccgtaagcttgtttttgaaacaccagcttttcttgactacttcttgcaagctacaccaattaagcaaatttccaacttaaatattggttctcgtccagcagcaagaaagaagattactgatttttcaggcttaagagctattccttgggtattctcatggtcacaaagtcgaattatgttccctggctggtatggtgttggttctgccttcaagcacttcattgatgccaatcctaataacctccacaccttacaaaagatgtatcaaggttggcctttcttccactcccttctctccaatgttgatatggttctttccaaatctaacatggatattgccaaacaatatgcggacctatgtgaagatgaagatactaaaaaagtctttgatactatctatcaagaatggaaacttactaaagaagtaatccttcaaattgaaggtaacaaagaattacttgcagataacccaagtttaaagatgagcttaaattaccggatgccatacttcaatattcttaactacattcaaattgaaatgattaaacgagaccgcgtcgatgagattgccggcgtttatgaaagtattttaccgattaccattaatggggtaacctctggcttacgtaattcgggatagttttaatttttaaggacaaaatatgaaaaaggcactattaattattgactacactaatgacttcattgcagacaatggttctcttacctgtggaaagccagctcaagctttagaagattatttaatcgaattagcaaataaattttatgataatggagactatgtaatttttccaactgatggacataccggtgatacatttagtccagaatataagctctttccaccacataatattgttggtacaccagggcaagagttatacggtaagttaaaagaatggtatgaagctcataagtctagtgaccgagtatataaatttaacaaaaatcgctactcttctttccaaaatactaatcttgataattacttacgcgaacgtaaaattaacgacttatggttaactggcgtatgtacagacatttgtgttcttcatacagcaatgactgcctataatttaaactatgatttaactattccaagtaagggtgttactacctttactgaacatggtcaagaatgggctttagatcattttaaaaatgccttaggcgcaaaagtaatagaataatagaacaaaaaactgtatcatctgatttttcagaatgatacagtttttttctactttaattttattaactcgatactatcaataccatcgatttctttaacattaactgccacttgttcgctcaaggctgttggaatattctttccaacaaaatctgccttaattggtaattcccgatgtcctcgatctaccaaaaccgcaactgcaattgactttgggcgtccagttgcaatcaaagcatccatcgcagcccgaatagttcttccggtataaaggacatcgtctactaatacaacatgtttattagtaatatttaaattttctggttctaaatttgaaatcttttcttgattaatatcaactctacgatcatctcgataagaggttatatctagttcccctactggaataatcttcttttcaatttcttcaagtcgatccccaattctacgtgctaaatagaccccacgagttttaattccaactaaaaccagctcatctacgcccttatacctttcaataatttcatatgtaatcctaacaatagctcgttgcattgcaggcttatcccaaatttcttttaccattgtctcttttcctcaatcagggattatttctactattttaaagcgtctgttgcaaatgacctattttcaagagatgttaaaagtgcgtcagctgtgtccagtgctgtcaataatgggacattctgttgtatagccatttgtctgataataaagccgtcagaattcttctcaatatcatgccccatcgtattaatcactaagtcaattcttccctctcttaattcatttaagatattgtcatctgcattttcgctttcatgaactttagttacaagatcaacatgtaacccattattctttaagaagtctgctgtacccttagtagcaaaaattcgataaccaattcttgcaaatctctttgcaattgggagaatcttttctttatccttgtcttcaattgttaacaaaacatttccattttcaggtagttgcatcttagctccggcaaaagctttataaagagctttcgcaaaagtatggtcgcttcccattacttcacctgttgatttcatttctggcccaagatatgagtctacgtcagctaacttgctaaaactaaaaacgggagccttaacactaatcatttctggttcaggtgctagaccatcactgtagccctgctgcgctaggctttcgcccataattacccgagtcgcaacttgtgccatttcaattccagttatcttacttaaaaatggaactgttctacttgcacgaggatttacttcaattacataaacttcaccatttctcacaataaattgaatgttcataattcccacacaattcaaagtaagagcaagcttacgcgtaacatccataatcttatctttaacttcatccgtaaagttttgcggtgggtaaacggccattgaatcgccagagtgaacaccagcatgttcaatgtgttccataattccgggtagtaaaacatcctgcccatcacaaattgcatcgacatcacactcacgaccgtctaaatagtcatctactaaaattggatgatcagctgcaatgtctacgtggtcatgcaagtattcttcaagctcactcttgttgtaaacaatttccattgcctttccacccagcacataacttggacgaactaagaccggataccctagctcttcagccgctttaataactccttcatgtgttgttgcagttaagccctttggttgatttaatttaagtttcttaattatttgatcaaatagttcacgatcctctgcacggttaagatctttaacactggttcccaagattttaatcccgtgatctttcaacccagcagccaaattaattgaagtctgtcctccaaactggacaattacaccttcgggcttttccaaatcacaaacattcaatacatcttctaaggttaatggttcaaaatataatttatcagaaattgaaaagtccgttgaaacagtttctgggttcgaattaataacgattgcttcatagcccatcttttgaagtgcttttacacagtgaacagttgcataatcaaactcgacaccctgtccgattctaattggaccagaaccaataacaattactgattttttaccagacttatgtgattcattttcaccatcataagttgagtaaaagtatggcgtctttgattcaaactctgctgcgcaagtatcaaccatcttgtagactggaatgatcccattctttttacgcaagtctctaacctgatcaatactttcattccataaagtagcaatggttgcatcactaaaaccatatttcttagctaaacgtaaagtttcaagattatctttattttcttggatatttttctccatctctaccatgtgactaacaatatctaagaaataaaagttgatcttggttaattcatgaacatcttcaagactataacctctgcgaaaggcttctgccaaataaaagagccgatcatcttgtgctttaactagcttttgttctatctcttcatcacttgcatgatgagctgtttcagaatagagatctttttcgtcaatttcaagagaccttaccgctttttgcattgcctcttcagctgttcggccaattgccattacttcacccgtagccttcatttgggtacttaaagtgcggtcggccttagaaaacttatcaaatggccagcgaggaattttgcagacgacataatctaaagctggttcaaattcagcatatgttgttctagttaccggatttttaatttcatctaatgtcataccaattgcaatttttgcggccatttttgcaataggataaccggttgcttttgaagccaatgcacttgatcgtgaaactcgaggattcacttcaatgacatcatagtcaaagctattaggatctaaggctagctgaacattacaacctccctcaattttaagagccctaattaaacgtaaagagcaatcacgaagcatttggtattctttatcactcaaggtctgactaggtgaaaaaacaatcgaatccccagtgtgaattccaactggatcaaaattctccatgcaacacacaatcattgcattatcatcatgatcacgcattacttcaaattcaatttctttatagcccgcaatcgatttctcaattaaacattcagtaacaggtgacagttctaatccgttcttggcaatttttgctaactcttcatgattattacaaataccaccaccagttccgcccatagtaaaggctggacgaacgataattggatagccaattctatcgccaaactctaaagcttcttcaacagtattaacagttgttgatggtggaacgggctcacccaattctttacataactctttaaatttctctctatcttctgcttgttcaatcgaagaaagtcttgttcctaataattcaatatttaactcatccaaaattcctgttttagctaatgaaagggccatatttaatccaacttgcccaccaagcgttggtaaaattgcatcaggatactcttgtctaatgattcttgagattgattccacagttaggggttcaatataaaccttgtctgcaatggtagtgtcagtcatgattgtagctgggtttgaattaactaatactacctcatagccctcttcgcgaagagctaagcaagcctgtgttcctgaataatcaaattctgcagcttgaccaataataattggaccagaaccaattaccataatcttatgaatatctgttctcttaggcatgacgctcttcttcctttctttggtcaatcattgacataaaatcatcaaataatgagtcttcatcatgagggcctggagttgcatcggggtgaaattggactgaaaaggcaggatattttttatgacgtaatccttcaaccgtgccatcatttacttcaacatgagtaatcatcaaattttctttatcaatagatttaggatctaccgcataaccatgattttgagaagtaaaaccaatattaccagtggcaatttctcttacaggatgattaaagccgcggtgtccaaatttcattttgtaggtactagccccatttgcgagtgcaaagacttgatggcccatacaaattccaaatagcggaacatgtttttcaacttcttggaccatttttgcagccataagcatttcttctggatttccaggtccatttgataaaagcacaccatctggattaagatttaaaatttcttcggctgttgcagtgtaaggtaagacaatacagttacagtctctctccgctaattctcgtaaaatactatgcttaataccaaagtcgataacaactatatttctttttgagccaggtactggataagagttcttcgttgaaacacggctgattacaccgtgggtaatgtttttttgctttaattcttgagcaatacttactgcattttcctttgaatcagtaattcttccttttagggtaccgtgaattcttaatttcttaaccaattcacgggtatcaactccctgcaagccagggatgttcaattgttttaaaaattctggcaaggttgtttgcatacgccaattgtatgggtgacgtgctacttggtggcaaataacgcccttaatttgtggctcaagtgattcataatcagccaaagtaatcccataatttccaattaaaggattagtaaaaaccaaaatctgatcggcataactttgatccgtaattgcttcttgatagcccgtcatccctgttgtaaaaacaacctcaccactactttcacaatcagctccaaagccttcgccttcataaatactaccatcttctaaaattaaatagcgtttcattttgttcccctttgatatacaactttaccatcaacaaacgtcatcactgtctcgccatataccttatgaccagtaaatggtgtatttactcccttagacttaaaatcatcttctttaatttctctttgatgctcaatatcaaaaatcgcaatatcggcattctcacccggtgcaagaagacctgcattttctatgccaaatactgtagctggcttatcagtaagaagagatagtaattgttcaagcgtgaaaactttttcttcctttacaaatctagtataaagggtgctaaatgctgtctcacttcccgtaattccaaaagcggctcctcgcataccaccctgtttttccgctttagcatggggagcatgatcagtcgcaattaaatcaattgttccatctagcaagccaactaacaaagctacctgatcttctttacttcttagtggtggattcatcttgaagtaagcattatcttcaggaatatcactatctgttaataaaatatgatgcggtgcaacctcacacgttaccttaatacctcgtgcttttgctaaacgaactaattctacactggtttttgtcgaaacatgacaaatatggtaatggactcctgttttttgtgctaaaaggagatcacgagcaatttgcgtagtctcagcaagttctgtaactggtggtaagtctaatttttcagctgctattccttcattaacaattcctttattaaaaagtgaatcatcttgggcatgggctgcaataattaagttgttttctttagccttttgcatggctagatacattgtctgcgcactttgaactccatgtccgtcattacttaatgcaaatgcgcctgctttcttaagtgccgcataatcaggaataatatcagttgtttcatcattagtaacaggaccatactggagaatatgaactaacccctttttttgattttctctaaccattttatccattaattcagctgtattaggaacaggagtgacattaggcatagcaccaacggttgtaaaacccccacgtgctgccgcttggctaccagttttgatatcctccttatacgtttgaccaggatcacgataatgcacatgaacatctactaagccggggctaactatcattccgctagcatcaattatttcttccccttctaggtcagttccaatagccttaattttttgaccatcgattaaaacatcggctttgattaggtggccgttttggtacacagttccatttttaattacagtagtcattacttgagtcctcctaattttcttcctcgtaagactgcttcaatcattgccattctcataaatacaccattttgcatttgacgagtaaacatacacttgtcgctttccaccaaatttgcacttaattcaacatcgtggttaattgggcccgggtgcataataattgcatttggctttaattcttgatagcgttggttattaattccgtatttttcatgatatgcttttgcatcaaaattcttttcattaggatcatcactatgtctttcatgttgaactcttaatagcatcatcacatccatctcggaaatcaacttatctagttcttcatattttccatatttatcaaattccttggagtaccaatattcaggtcctgaaaagtaaacttcagctcctaaccgatggagtaattccatattacttttagcaactcgtgaattagtaatatcgccaacaatagctacctttagacctttaaattgcttaaaatgttcatgaattgtcatcatgtctaacaaacattgacttggatgttgaccactgccatctccggcattaattattccaatatctaaatgttgatgattttgagggcggattaaattttgatagtattcattttgtgaatgacgaattacttcaatattcactcccacagcttccataatcagggatgtatcatataatgtttctcccttattaactgaagaatgagcaggatcaaatgggattacggttaaacctaattttctttcagccatttcaaaactagtatgcgttctacttgaatcttcaaaaaacatattagtaatatagatgggctctgttagattaggcgtagctccgccatttttaaaatattctgctcgattaattaaagcttcaacttcttcaacactcagattttctacactaacaaaatgtggtaaactaacaagatttaaattttccattttttattctttctaaagcaaaaaggcctgaagcatttaattgctccaggcctatttttcatattcttgcatacgaaaaatatagcaacccttctggccctctctggagtcaattaaatggttgactattaaattaatattttttaattattttgatagagatttcagttcaactgaatccttaccatctttttctaccatgttaacagcaacttgttcgttagctgcagttgggatattcttaccgacaaagtcagctctaattggtaattcacggtgaccgcgatctaccaaaactgcaactttaattgaactagggcgtccatcatccatcaaagcatccatcgctgctctaattgttcgcccagtatagattacatcgtcaattaaaattactttcttatcggtaatatcaacgtcaatttggttagaattgactactggatcttgttttaatgaagcatcatgacgatcatcacgataaagagtaatatctagctcatcgattggcacatcaacattttctaatttttgaattcgttcatgaattctcttggctaaataaactcctcttgtcttgattccaattaaaacaagattatcagtacccttattttgctcaataatttcataagtaattcgagttaatgcacgcttcattgcgagtgcatcccaaatttcctttgccatatttttcctcctgattttgcccataaaaaagctcctagttcttgagactaggagcttatagttaagtcatacttatttaagcctgccttgctagcctcacgggactaattttaaaggacatttattgttttaaaattactgtacttcatgatttttgtcaagccatttaattaaaattgactttattcaccaattgattaatatctgtaatccctaacttttctaattcctttggtaagtcatcagcaatatgctttgaagcgagactatccttaaaatgcgcagttccaacagcaactgcattagcaccagctagaataaattcaattacatctttagcggaactgattccacccatcccaataattggtaaagttgtactttctcgaacttggtgaaccattctaatagcaattggttttacggcttcaccagaaagaccaccaatattgtgccccaaaacaggctttctagtttcaacatcaatctccattcccaaaagagtattgatcaatgacaatccatctgcgccaccattttcagctgctttcgcaatctgcgtaatatcagtgacattaggagttaattttacataaattggaattttaacgagtgacttaatttttttagtcaattcttccactacatcaggatgaacgccaaagctcattccgccctgattcacattcggacaagaaacattaatctctaaggcattgactagtccagaatcagatagcttcttagctacttcaagatatcctgcttcgtcttctccaccaacgctagccataattggcaagttaggatattcactacgcaaaggagttaacttatctttgattaccgcatcaacgccgggattagttaatccaactgaattcaaaactccagtatttaaaacagctatttggggctgcggattacctgttgtactatgaggagttgttgtctttattaccattgctcccaaatcatttaaattaaatttcttggctgctggtacatcaccaaaaccaaaggtaccacttgctggcataattggattttttaaatctaatcctggtaattttacgtgtgtattaatcatattttcctccaaaatgaatgctctctgtcattcaattatttttcaagaattgattgtacacgcttttttatttttttcaaagttaaaaattttatttgtaattctttctcgaagatgctaaacttcattttgattaaactttaaacggtacagagagaccgcaagttagaattattggcttaaattatctgggaaagtctatacctagtgtctctctgcgcttggtatagatttttttatggaggaaaaatgagtagacctgttatcgttgccttagatttagacaatgaaaagaaattaaatgaactattaccgaaactaggtaaacctgaaaatgtttttattaagatcgggatggaactcttctttaacgaaggccctaaaatcgtaaaacaattatcagaacagggttatcaaatctttttagacttaaaaatgaacgatattcctaatacagtctataacggtgcaaaggcattagctcgtttgggtattacctacaccacggttcacgcacttggtggcagtcaaatgattaaggccgcaaaagatgggttaattgcgggaactccgattgataaaaatgttcctaaattactagctgtaactgaattaacttctatttcagacgaaattctacattatgagcaaaattgcaatttatcgatgaatgatcaagtattaagcttagctacaacagctaaaaaagcaggtgcagacggtgtgatttgttctccactcgaagttaaagacttacgtcaaaaagttggagaagactttttgtacgtaactcctggaattagaccagctggtaatgctaaagatgatcaatcacgcgtagccaccccacttcaagcaaaagaatggggttcaacagcgattgttgttggtcggccaattactttagccactgatccagaagccgcatatgaagcaattaaaaaggagttcaactaacatgcataaagatcaaattattagtcaattaatcaaagaaaaaattattactatttctcctgacaaacctttcacttatgcaagtggaatgctttcaccaatctataccgatcttcggttaactgtttcttacccagacctgcgtgatatgattgctagtgatctatccaacctaattgcggcagaatttcctcaagcaactattattggcggagttgcaactgctggtattcctcatgctgctttagttgccgaaaaattacatttaccaatgatttatgttcgtccaaaacctaaagatcacggtaaaggccgtcaaattgaaggtcgtttttcagaaaatgatcaaattgtcttaattgacgatctaattaccactggtggatcagttttaaacgcagttaaagctactgaaaaagatggcggaaaagtagctggggttgcttcaatcttcacttattatttgccagatgcaaaagaaaactttaaagaggcaaatgtaaaatatactccccttctttcttatcctgaattacttaaaaaagaaaatgaatctggtcatattaccagtgaccaatatgatattttaaaaacctggcatgaagatccatgggcttggggtaaaaaatttaacagttaaatctaaataagattatcatcatatagttaatttaaaaatagttaatttaaaaagagactgattttttattttcagtctctttatttatttccagctattttattaataaaattttctttaatttcaaactggctacaaatatttatcaatactgcaagttacttaatcgccttatttaccatgtggtagacttaaggagagtaagtgattttcttttttattagcaattcgttaataaaaaatacaacatttatctatataatgaaattacaattggcagaaaggacggatgaaatatggatacaaataatattttgtcttacataaaatggcgtggcgatatttccctttctgtacgaccctttgacgaagttgatgcattagtaattgccacgttttcttatattcatcttgacggaattgtccctgattctaataaagagatttcaataaaggaagccgctaagaaatattttaattcttcaaatcaacatctcgaccattataagtatcaagatttactaaaattaatggcaaattctgttcgttttggagatgcgaaattatcctactttgtagatgttcttactgatagaatacaattttctgcgatcaaaattagtctagataatgatactaattttatttcctttcgaggaacagatgacagcttagttggctggaaagaagattttgaaattagttttagaacaaccggtgcacaaaaatatgccctaaagtatctgacaaatattttaaagactaccaagcaagtctacagtttagctggtcactccaaaggcggtaatcttgctgaatacgcagcagttaacctacctgatgacttaaaaaatcaaatcaaaactatttacacttttgatagtccgggacttagtactcaagttgatggagttactgataaattaaaacgttatgtgcctgaatttagtatcattggccggctttttgagccagaaaacattaccccaacaattttagttagtgatcggccaaaactagctcaacatgatccaatgagctgggaagtatcgggttctcactttattactagagctcatcgcaatccaacttctaaaatatataatcaaatcataaatcaatggattggtgaagcaaatcttcaagaacgtgaagctctaacaaatgatctatttaatgcttttgcagctagtggagcaaccaaaattacagaacttaataaaaatggttttggtggttttggcgctattcttttctctcttactaattcatctagaagaacgcgatttgttctcggaagtttatgggaaaccatctggcgcagtatgaaagcaactcatctagagaaattatttataaatcccaattcaattattggatgggtattaattattcttggtattgtaaacctgatgattcctgattatgcctatcgagcatttggaggaatagttggcgtcttttgtattggatggagtggttatcatattgttacagctgctaactcccatttagtgcccaagtcaaagcaattctttattattacttatctcattgtttttggcttagctgttgcaattatttctaataaccgtttattggctttcttagctcactatgttctagggatcttcttgatcggttttgcatatgtcagattacgtaatgtaatcgttaaaaataagaaaaatggaattttcaaaaatattattgatatcatagaaagcttaattgcttttgctgctggcattattgtaattgtcaatcctaattatttcagtcgtcaagcagtcattattttgggcattttactgatcatttatggcctcttccagctaataatggagttatttaaacaaagaaaatcaaaaattccgcctaaacatcgttaacaaattaaataaggcttttggaacttaatccaaaagccttattatttgcttataaaattttttcaattgcctcggctacaccatcatgatcacaatcacttgttactctttgagctgcttctttcacagcaggcactgcattacccattgctacaccaacacctgcaagtttaatcatgcttagatcattttcttcgtctccaatagccatcaaattttcactacttaaattcaatttgtgacaaagaaattttaaagcatttcctttagaaacacctttaggatttgcttcataataaaagggtgctgttttagtaaaagtaattttatcatctagatgggcaaaaggcttatgatcagcaattttttgatctaacaaatctttctcatctacatacatgcacttaataattggaatatccttcatttcagctggtgtacggtacgaaatacctaaattaactaggttcgcttcatataaagtatagtcgccaatatctcgatctgcggtataaattctatctggtgctgatgcatggaagtgtaaacctaattttaaggaaattgtctctaaatctagataattgtcataggttaattttttctcaaataagacatttcccgccgttgtttctactactccgcctccaaaacaaacgacgtattgatcttcttgatcatttaaacctaactcagtcagaatcttttctactccgctcaatggtcgacctgtagcaataacaatttttatccctgcactttttgcttttaaaattgcatttcttacttttggagtcagttcttttttagaatttaataatgtaccatcaacatcaattgcgattatttttatatttttcatcttataatttgcctcaatattgctaatcctacaactcctaatccaatgcatcccacaacgcttaattgcaagcgccaagtaatcgttaagtaggcaataaattcacgtacaaaggcatttaaggtaaagtaccactttgtttttgcaccataaccaatacactgtaggcctaatctctttgctaaaactagggcacgatatacatggtaagaattagttacgatagcaaaacgagaatctggtttcatcaatttatgtgaaaaaatcaaattttctctagttgtctttgacttatcttcaacaataatatcttgcttcggaacacctttttcttcagcatattttgccattgccactgcttcaggaatttcttcacctggtccttgtccacctgacataatgatttttgagccaggattacgacgatatacctctattccgcgattgattcttgcagcaagaagcggtgttaccttttttcccattaaacctgctccaagtacaaccacgtagtccaacttcttagtcttaatattcactagattaatccaagaagttaaagtatacatcatcataataaaaattagataaattattacgaggttaataaacaaatatatgtaagttccaaaattattatgggttaattttccgactaatggaaagagaaataagtaagcaataattccgatgcccattgctaacgataagaaattagtccagcgattaccttcgcgaattaaaatcttaatcccatcgtaaataaacataatgatcaaagtcgcaataaaggccacaacggaaaacattattgccagtaaaattagcacaaaaataagcaaaataacttgatgagtaataggaaaaacttcagcagcaattagtaagctaactgccgtaaatagaccaaaagtaattattgtccatactaaagtcatccctgaccataagcttcgcctctcatgagttaaaacccagagaaatgttcctaatgccagtaaaaataaaactaatacaattgaaaatgataagaccacttatcatttcaccaccttattctagtgtaagtagctgtacttacttttttcttaattatacaaaaataattgtcttcatgtttttgattcagtataattaagaaaatatttttaggaggacaaagaaatggcagaacaaattttagtaacaactactgaaaatattccgggcagaaaatatgaaattatcggtgaagtttttggtgttacaactcaatccaaaaatgcaattcgagattttggtgctggcttaaaaagtattgtcggtggtgaaattaaggcttatacgtcaatgttaactgaatcaagagatcaatcaattgctcgtcttcgtcaaaatgcctccgaaatgggtgctaatgccgtagttatgatgcgttttgattcaggctcaattgctggcgatatgcaatctgtcgttgcttacggaaccgctgttaaatttattgattaatctaaaaaaactggcttctcagccagttttttattttcttaaaccttttggatagaagttctttaaaatttgatcatttccaatttttccaaaactgaaaatatggtcttgataagcaaccaaaacaaagccgcgcaaattactatctaccttaatcgtttctccatgtatatagcgctcataatctaccttatcttcaaaattaataagttgtttttgttctttttgtcctaatacctcagctagttgatgactcggctcaaagcgctttttcttaagtaaccctaattcaacaccattatttagaacatgtagttcagttagcatgtctgggtcaagagctggtacaaagacgtgaccattactttgcaaaacctcattttgccaattttctaaactagatggtagagcaaaattatctaatacttttgcaaccacactaatctcatctttatttaaacgtgtaattgtgctctttttctggcgtttgttctttctctttttagccttagttgaaatctcttgattctcttcaatatttttcagatgagcaacaaactgtccttcacccactccattttgaaaccagagtctaaccgtttcctttaattctggcatgttagactttgaccaatctggtctaccagccgacattccggaatagagcttaagaggttcgatttctaacggataattctcaactagccacgctactatttcttcatcttcttctggagaatatgtacaagtagaatagacgatctctccgcccggctttaacatcttcattgcttcactcagaatttctttttgtctagtttggcatgttaatacatagtcaggagaccaatattgtgtcgcagcaggatcttttctaaacatcccttctccagaacacggtgcatcaactaaaattttatcaaaaaagtgaggtaatttttttgataagcgatcggggctttcgttaatgactacaacatttgtagctccccatctttctagattttctcttaaatcttttgctctactttttgaaatttcattagctactaagagccccgtattatctagcaaactcgctaatgcagtggattttccccctggagcagcacataaatcaagtaccttatcgccaggttttacattaagagaaactgctggatacatggccgatggatcttgggagtaaacatagccgcctgtccactcactatcacgtcctgaaatttctccataatatccatctttagtaaattcaattggttctttaagactatattgaacatcttgataattattctttagtgggtttaagcgaaatccctttttacttggactattaattgcagtaaaaaatttactactttcttcttctcccaataagttcttatatttctcaacaaattcaattggcaatgacattatttttccttcttaatttttattaaaagcagcattaatacataagtaataatctgcattgcaaaaacgattaaaaataggacatataactgactgtgattagagtaaaaactccacgtttgtaaacccaaactagtcaaaataacaattattccattggctaaaaagaaacgtaaaccagaatcagccaataagtgcgcccagattttactagaaacatattttaagtttaccggattttcagctaggactgctgcaattgctgcaactatcagtgcaattacaacacagaaaattgcaccgattaattttttagttggactgatcccatgctgcctattgtaggttttactaaagtccttaatctgcatacttccccggagataatgttgtaaggcattcgcctcgtttttattcaacccatctactactaccttatagttggtaattgattcttttgcagttggttggttaattccagttgaaagataataaacagcctgtccattttgactctcattgtttttctttaattcaccaataattgtgacgtaatcattattttcttttagatagtgattattctgtaaggttacaactcgatctttagtatcggatgagataactgcaaaaggaattgtcccatcaaagtcatttttactaaagtacctagaacttcctttagcaagcggttgacttttcaaattatagttagcccaaattaaaacgcggtctgggatatagtccgattcaaagtgaatctgcaccttatcatgagagaaatttttattaacataagttaggaactgtttaatattgtgttttttcttaggattaaaaacataatatgtgcttgataaaccgttattacttaaaacttgatcagctctctgagactgctgccgtgacaaaattaagcccagtcctaagaaagctaaaaaagaaattattaaaagaataagtcgttttattttcattattttatctcaaacaccttttcattaatgaaatcaaagcttcgaaaactccgattaacctttttattagtcgtagtttttgcctcttgccaaaaagtagtagaattggttgctccaaatttttcaccaataaataataaaactggctggtaatcaagctgacgataaagattgagaatatttacgtcatcttccccaaaattgggcgcccaagagcaaataattagatcaacttcgggatgcttcttaatcgcacttagggcatccaaattttctgtttcaaaaatcggagattcacctgttgttgaacttttcgcccaagcaaaagaatcactagccgtcgcttttatgccaacctcacttaaggcttttgaccagtatgcatttcccgccataatttctaagcttgatttaacattatattcttgtttgattaacttagcagtttccaaatttggcaaagaccagattccgtattctcttgaaagaaagctacgaaaattattcagtaaattatttacttcttgggccttctcgctgcttgccgtattctctatcattatatctaagctatcgggtaaaaagccaagtgaattaggtgatttttgtaaaatttttcccttctctaggtgagtaattatattattaatggcaatcacttgctcatgaagtggtaaataattgagttctttgtctaatttgttaagtttattttgatatttcttcattttatatcttccttatgcaatgattttaccattcaaaagaaataaaaacaggtataataaaagtgatgcaaaaattaaggagcaaaaatatggcaaaacataaaactgaatcggctgaatcttttggtcactggctcctacaagtatttattttagcaattataattattggattatatttagttgtatttcgatttttacttgctaatgaaactatcagtggaccatcgatgcagccaacttttgaaaataatgaccgagttattgcagtacgacattctaaactttctcggggcgatattgtaatattaaaagccccagatgaaccaggtgccctatatattaaaagaattattggagtgcctggagacagcattaaatcaaaaaatgatgtaatgtatattaatgggaagccaattaaagaaccatatttgactgagtacaagaaaaagctttccaaaggtcagctttacactaacaattttagtttagaacaactttatcatgtaaaacgcgttcctaaaaattggtactttgtaatgggtgatcaccgcagtgtctctaaagattcccgaatgattggatttatcaagagacaagatattattggtgaggtaaaattacggtatttcccatttaatcaaataaattggtactaatatattttagaaagtgtgaagaagagaatgagtcctgaagaattatccgatgcaattattgaatttgaagttaagaataatgtcaatgacactgctcttgctttttcaagtcatctttccgttgaaaaactccatgcaatgaaaactggagaagctaaatataccgtagaagaagctgaacaagttttagattatattcaagctaactcttaatttaattattcaataatagacaaaaaggaataaggttttggtaaaaatgatatgaaccccgaaattcggacaagaatttcgaggtttttattatgtctaaattatctaagcaagacaaaatttacatctacaataattgggagcgttatcataaatcactatctcaactaggtagagaatatagagtaagacctgacaatttatattatttaatccgtctaatagaccttcacggcttaaaaatcttgaataaatcatattcttcttattcagtagaatttaagaaaactgccattaaaagaatattgattaacgatgaaccagccactcaggtttcattagatttagggctacgtagctcaggcatgatctttaattggcttcgcaaatataaagaagatgaggagaatgtcattaatcacaagaaaggcagaccatctcatgaaaagcaaagaccaacaaatccaagagcttcaaaaacaagtaaaagacttaaaacggcagaatctcaagcttactgtcgaaaacgaatttgtaaaaaattgagcgcctttgtttcccaaagagaaaaccaaaagcatcaatgatgacatcaaatttattaatcatactatcatggatggcaaaaatatcatcgacaattagattagcatcattacccaggatttccttagccttactttcacgtctaacgatgcctgtaatatcagtttgcggattttcctttgtcagccactctgccattccagatgcaccaataacttcaactttcatcttactaacctctctttcacttttgtctaaaatagaccaatacttatctcaagcgtagcacgattatgtgaaaaagcgttgtaagacgctaatcaatggtggagaggattttttcaataaaaagaaaaaggatctggccaatttcacctagatccccaagtgtagttatcttaattttcagatattaaaatatttaacagcttgtttactgatagaaattctagcttcaattattgcgtgtggatccttattaaaaattgatacaatttccttatcagttttaaagtaattaaagctagcaaagaaagcattccaatctctataaaagaggtttgtaaattgtttttgtaataataacattgctataaaatctggtaaaaactctttatagacttgctgtagatttaaacttaaagttttatctttaatgttcaattttactaaactatatttatcacataaatatgtaaaaatagactttattttcatagatttatatatagatgttctattttgatctaagaaagcgtgtccaatttcatgatacacaaaaaagaaaaaacttcttgatcaattaaattattactattttgtagcaaaactaatctatttggtacgataatagttttggtttttactacataaataggcattattactttagaactaaaagttgtcataaaatttatcttaaaattatattttttgccaaaagctgttttcaaatattcattagccatgaaccctattttcttcaaattatgagtttctattttagcactcagaggaacatactcgttatgaattaaccttacaaaattactttctataccttctttttgcgtaactagaatattttcccctaatctaattttccaggtgtcgctcattaatgatcccatcctttgttaaagtataaattttaatcttatacttcttaaccaaattaaaatctatattgtgtgcaacttctatcatcatgactggtaattgatagattaatgttctaatcttcgttgaattttctttatctagacttgaagtgatttcatcaagtaaaaatagattcttttttcttaataagcctcgtgcaatcactaatctttgagcttgtcctcctgacaaattagtcccattgctttcaacttcaaaattcaaaggttgtgcgcctaattctttccataagtgaacttctttaagcacttttatcaatcttttttctgagaaagattgatataaggacaagttctctgcaatagttcctttaaacagccatggtttttgcgaaattagaactgaatcagacaaagcaatcgaaccttgaccaaatttaacttgaccagaaattggagttaattgaccagaaattatattgagcaaagtagattttcctactccagaatctccggttattattaccttatctctatctttcatttgtaaattaacatgcttaaaaatcaactttttatctctagcaaatgatataccattcactgagagttgattttgtgaggtagttttcaccgctttatcagtatcatcttgaataattttaatattacgaatgtttttagtacttgtaatttgtgtttgataacttgaaaattcacgaattccaccaagaacatggtctgtggtcaaagacaaggtcacaattgtacctatttctacgccatccaaatgatatgccaccattaacagaccaactcccattggaataacgtcagcgataatagagcacatccaagcacagaattgaacggaaaattgaacacgatttaattgaaaatatctctcttcctcttcgcttaacgtgctaataaattttctaaagaaaagatttttgacgtcaaatttcctaatttcatttttcccttggaagatatctttcatgactgtaatcaacgatgaattgcactcactccatgaatccattttttgattcattctttttttaccaatttgattaggaaccatacttaataatgaaagaataatatagactaaccctaataataaattagtttttaaaacaacaattgtagttgaaataatagtcattaagcactgaatcaaattaaatagcggctgaaaatattgcttttgaatttgattggaaatactagcaaccttattgattacgtctgatgagcttacgtttaaatccttttgtttataaaaatctgaagtaaaaaaagtatactttaacttttcatttaaatattgaattgccttttgagtagttaacaaaaatagataggctgatacataagtaattaaataggcagtaaatactagaagcaaaaaagttccaacatttgcaaaattatggaaagaaatattagtcatctgtcctaaaacgtaaccattaattactccctcaaacgaactcgttactgctaagataatgataataacaattaagttaacaggtaaaacagataacacccatttcaagttaatttgtacttctttttctttcattaggcattacctcatttctttaaaaattatattttcactacattgcagaaggtcccaatacatataactcggaaaatgtcgaccacgctaactcttctcttggattttctgcctcttgtaattttcctaatgaatcactaaatgtatttaaatctttcataatatcatcttttttcattcaagtcctatcttaatacaagcataacaattactttatgtatctttggaattttccatatcggttagacttctttagatttataaaggaaaacatggtcccatcacttttcacctctatctattaaattttgtattcttatattactagtttaggattttcagcatttaaaaagtgtcacatatgacactcattttttatacatctttttaacaaaatcattcatgcctatttgctgcaaaaagtttataatttcatgtattcttttataatccttattcaacaagctttcataatattttcccataattaacgtaaaacaatttttaggttttggctctgtttgttttaactgtgttatcgattgccaaactgtttctgtattttgattactaaagcgaaaagaataatctaaataatttaccagaatagctgacataaatttttttaaatcattacttgcataatgatgacatttatctaagatttgccgcattatcacatttaattcctcaatattaaataaattcatagacattgaaaataaacacaaactatatttatcccaattgtcagtttcaaaaattaagttcttaattgtatttatttctgaaataggtattctatctctgttaccttctagatttgcttctaataagactgcaagtgctaataaaatattaattcgtctatcgtgatgttcattctttaaactatctactactttctgaatcctaatcaagtcattttcataataactttctcttaaagcatctatataacaatcatattttgatttcttattattcttttctaacatggagaaaaatttagacggctttatatcatgcaattccaaaatttttactaaatcacaagcttttatttcaaactctcctcgctcaatttttgaataatatgatttagtgagaatattacctgccattttttcctgactaagccctaacatttttctaatttgttttaatccattcgctatcttcataattatcactcttactatcttatctttttctgaattaacttttaaaaagtaatatagcctttcatattacctttgtcatactataaaagtacatagcattctcttataactacacattataatttatattttgtcctaattgatttatcttttttctgtacagtaatctgttcaataaaaatattcttagatttaaggcttacaaagatgacacatctataaacaaaaagctcatcctgctttccaaaactggcttaaaaatcatggtattgaacaatcaatgtctagaaaaggcaactcattagatgatggattaatggagggcttctttggaatcttaaagcgagaaatgtggtatggctttgaaaaaacttttaaaaatctagatgaactagaagaagcaatcaaagactatatttattactacaataattttagaattaagagctcaataaaaaaccatacttcgattcaatatcgaaatatggttttaaatcaaacagtttaataatatgtcctaatttttgggttcatatcaaaatcaaaatcttattcctttttcttatatccgcgcttcatgatacttcttcagtagagtaatattcactaaaactaaaattatatttacacccagaactataaataaagttaagtaattactcgttaggtctgatcttacatcactggcatccttacttaaagtagttaaaaacattccattttgcaaaaagccagttagtgaggtaaaaataacatcgtaagtattaatcaaaaatattaatccaatacaacctaataaaaccacgactaagaaataaaccaatttacttattctttcaggaagaaaatcactaactatttttcccgtaaaattaacgagactcacagcaagataaatgaatataccaattagaactatcaaaacaatgctagacaataaatccattatgtgcatctcttgccataactttccttcaccgattgacccgaagtttttaaaagtagtcttccaaaattcatttgttcccattacaggtattcctgcagcgagaatcatacctatttgcaaaaccactaaataaagaccattaacaacagctgataaaagatttgcaaatagtaaagaactttctttaattggagctaatcgccaagtttgagacgaatagacttcctcattttttcgactcgaaagagctaagtaggctatatcaaatagtggtgtgatcatcagaaaagctactaagaaataagccttactctcaccctcaaaagctgaattaaagagtgcccaaaaacctaaaagaattccaacaatcacttgtaaaattgctagtcggcggacaaggcgtactttgcttttagtcaattctttaaatattgatgaaaaagttgccatatactcttacttcccttcgtggaagttcttcaaaagccaaacattaattgaacctaaaacaatatcaataaatgccaagactaaattgttttctataaatgacattagaccattagtagtgtcaccccaacggacttgatttaataaacttcctagattatttgtcaaaacaataaagataaagatcaaaataatcataatgacaaaacgaattaatttactatgtttatcaggaagaaagtcagtaatggttctacttgatagattgagcaaagtcacaatgctataaaccaaaattgcaaataatataaaggctaaaaatgcacttagtatttctccaattggaaaagcatcagaaaatttttgccaaaagtcgcccgcatgagtttctttagcaagggcccggttaatttcccaaatattagttctaacatctttacttaagaatgctggtaaaaacgtaacaatccccattccaatttgaattaataccaagtaaagcccattaacaatagcagaagaaatatttgctaagtaaaatttacttgaagaaattggaactaaacgccaagtctgagagctatactctttttcgttttgccaagcagagagaactacataggccatatcagctaatggagtaaaagtacataccatgacaaaccacgcaatcggtttatctgaatttgaaaatccaccattagaaaaaagtccccaaagtgcaaaaatagatgcagctactaattgcaacagagctaacagataaacactccggcgcttctttttacccatttgattaaatagtgctttaaaagtagtcatccttattcagctccttcatctgcgtataagctttcataatactcttcaatactttttccgtgtgctcttatatcatctgctgaaagatgactggcaatttttttatcctttacaattactacttcatctaaaattgttgtaatttcatttacaaagtgatcagaaataataattgtactgtctggattcttccaaagtaagattgaattgatgattctctttcgagccattggatcaataccagaaaatggttcatccagtaaatacaacttagcttccctacttaaagtaacagcaatttcaagtttttcacgcattcctcgcgataattgacctaacttcatctcattgttaagtttcatgaaggaacgtaattgttcgaatttactactgtcaaaatctgaaaataatttttgatagaattcctctacttccccaattttagtggaatcactcaatccctttaaattgtcagtcatggcaatattagctttacggtaaacttcactaccatccccattgagcagtacttcaccttgataatgcttagcaataccaacaattactctcattaacgttgtcttaccagcaccattttcacctagtaaggcaataatctttcctgaatcaacatctaagttcacattatcaagaatagtttttaagttttttcgatatgttaattcttttacttcaagtagtttattcattttaatctcccttcttctcctcaataaactttttaagctcttccagcgtcttttctggagttaagcctaattgtgcagtactttctaaaaattcactcattgtatccttaattagctctctacgcttttgtaaaatcaactctgtatctgttgttacaaacgaaccaagtccgcgcctaacctctaaaattccctcgatattcatttgattcaaagcacgctgaaccgtattgacatttactgttagatcaacagctaattggcgaactgatggaactttttctcctggcttaattttccccaaagcgatttgtcgataaagatacttttcaatttgaacataaattggaatattatcttgaaattgcaatctttacacctctttactagtgtacggtttatctattacactattataataccaagatacattttcaaatacaagccataattttgtttcacaatttagaaaatatattttttaataaaaaaatagtagataaaaatgctattatttcaagcattttatctactatttagcagattaatagtatcagtgtaaaactatttttaatttttaattaatttaagatcattgataaataagtgtttttagccattcaagcaatcatagaaaatagagaatttaatcagaatcacttgaaaattgtttcacttatttacttcttatttctctcaacgtttaattgattaatcttacgcaagacgtctactgctttccacatactctcgagtacagtgtattcatagcgtccatgcatattttcttcaccagcaaaaagatttggacaaggtagacccatataagttaattgagaaccatctgttcccccacgaactggatcttcattaacagtaagcccttcagccttgtaagcatccctagctaaatcaacaatctccatgtgcttttctaattcatcagccatgttgtaatattgatcccacattttcagcttaattctttcagtaccaaactcgtcattcatcttcttaacgatgtctttaactagattctttctcttttcaagaccatcacgttcaaagtcacgaatgatgtagtccatatgtgctgaatcaactgttccatcaaaattcatcaagtggaagaacccttcacgaccttcagtatgttctggacgatcatgttcaggcaattgattatggaaatcaatcccaacttgaatagcattaatcatttggcccttagcaacagctgggtgtacattaacaccttgaatatctaagccaaattgcgctgctgaaaaagtaccccagtcgagttttcctggtgcttcaccatcaacagtataagcaaaatctgcaccaaattcttcaacatcaaagtgctctgcaccagtaccaatttcttcatcgggagtaaatgccaacttaatttcgccgtgcttttcttcgggatgctccatcaagtattctgcaaaagtcattaattcagaaataccacacttatcgtctccaccaagtaaagtatcaccagaagcagaaataatagtttggcccttatagttctttaaatgagggaaaacttctgggtctaaataaaattcagtatctcccaattgaatcttagattcaccatcatagttttcagtaatttgcggtttaacatcaaccgaattaaagtctgctgtatcacagtgagctaacaaaccaaaagtaggtacttcataatcaatatttgaaggaatagttgcaattacacatccacttttttgattatagtgaacatctttaagacctagttcttctaagtctttcatgattacatttttttgaaagttttcttctctttcagttgatgggaaacgatctgaatgttcgtcagagcgtgaattcaccttaacgtattttaaaaatctaggtagtaaatttggatattctgccatttttaatcctcctaaaataaatcttgaaatgggttagttgatacctctgaaattactacaggtacattccaattataatcctgattccacttttcaagtcgatctccaaccttatatttaaaaagtttttcagtgtagtgtcctggatcgactactgttaacccggaagagatcatatcgtgaccaacatgatagtatacatctccggttataaatgcatcgactccatcaactagagcttgacgccagaacttaccaccatctccgcaaataaaggctacagttgagattaacctatcattatcagcagtaatcagtcttgccattggaatttgcatcttgtctttaacataataggcaaattccttagctgtcattttcttaggtagtttaccctttctaccaatggcaattccatcagtatctaaggcaaaaggctcaacctcttctaagcctaattcttcagcttgccaatctgctgaaccattttcagccttatcagaattagtatgaattgaataaacagtaattccattagcgattaacttaccgtacattgcattttgaggatcagcaaaatcaagattcttagctggtctaaacatcactggatggtggctaattatgaggtcaacacccttttcaattgcttcatctactacttgtggccgaacgtctaaggtagtcattaccttggtaacatctgcatccattgatccgatttgcatcccaactggatcaccttcagaagcaatttcttcaggaaagtctttttttaagcgagctacaatatctgctacttttgtcattttagtacttcctcaatcatttcaatcaaatcatctatctgactaattttagcctcatctttatttttagccttatttaaattagcttttagattttcatagtaattaagttgcttagtccattttttaataaaaactggatttttttcttttaataaaaatggaccaaattctaattcttgatcagataaattatgtttagcctcagttaacttagccttgattatttcataaatgtggccagctacttcgataatcttttcttctactatctcatactgatgatcaacgagccattttctgactaaaggctcacctatattagcttctaaaattaaagtaggatagatctttccctcttgatgagcagtttctaacaaattagtcatgagctttccacccattccagcgattacgactgtatcaatttggtcactgctctttaaagtttctaatccagagcctaatcttgtctcaatcttatcttctaggcctgcttgttcaatatcttgttttgcattatctaatgggccagctgcaacgtcacttgcaattgcaaaatctatttttccttcttctactaatgcaattggtaaatatgcgtgatcagttccaatatctgctacgcgactttgtggatcaaccattttaccaatttgagctagtctttcttctaacacactctcacctcttattaaaaattttagcatagataatcccaaacttacttgaaaaaatggctgtataatttttcctgttgatgaatatctatgatattctatcgacaggatttttttacgtaaaaaaagaggccatagtcctctcttacttaaaatccttcttcgaccaattcaattaagtgtatggagatttaaactatgtcctctttaaatgattatattaaatttactcttgatattgaagataaaaacattattttttctgattattcaaatgaaaatattaacggtaagatttacaaaatatatttagctgagctgatccagcctacttgtccttattgtcgttctactaatcttaagcataacggtcattacgtctctaacgttcgtttcattactgctgatgctagtaagcccgttactatcagattaagaaaacaacgtgttctctgcaatgactgtttaaaaagatctatggctcaatctaatctggttaataaaggctgctatatctctaacacttctaagcgaaaaatactttctgctcttactgaagatcgttcaatgaccagcattgctagagaacataatgtatctgtcaacacggttcaaagagtattagaagtctgctcttctaagttctatgatgcctttgatcatctccctgaacacttagcttttgatgaatttaagggcgtaggcaaaaagcttcactttatttgtctagatggtgatactcacaaagttgttcaaattcttagaactcgtttcaaacctgatattctacgctatttttacaagttcactcctaaagctcgtgcaatggttaaaacagtaactatggatcttaattgttattatcctttagttgctagagaattatttccaaatgctcagatagttattgaccgttttcatatggttcaaatgcttactagatcgtttaatattttcagagttcaaatcatgaagcaatttaataaaagaagccgtgaatataagcttttaaagtccccttggaagctttatctcatgaaatatgacaaacttaataagactactccttattacgactggcattttaaggactgtctaacacaggaacatgttgtcttagatggtttagattgtgaccaaaccttagaaaatacttattgggttatgcaggactttatgactgctattcaggataacgatgaaaagaaagttatccatctacttcattcaaaacaaaatgttggtaaacaaatgcatcaaactctattaacttttaaacgtaattattctggtgtcctaaacggtattacctcaacttattctaatggttgtcttgaaggagttaaccgtaagattaaacaaattgaacgtactgcttatggttatagaaatttcaaacatttattaattagaattagactcgaagaaaatattataaaagaaaaggaatcaaacagctatttcttagctgcttaattccttcttaaaattatccatcaacaggatttgcaaaagagccgaaaaaatttttaatcataaaaaaagcaataaaggctaaattaatcctttattgctaaaaattcaattatatttacttgttaataatgatatctgatggcttaacatcatcaccaaagtaaggctttaattcttggttgtagtcattaataaagaagccatccttgttaagcttattaatgtgtttattggtccagtcaagaagtgacttattccccttcttaacagcaggagcaatgtatgaatttggtcctaagtgcttgataccaacagtatacttaggattgttctttacccaagcatataagtaagagttgtcatcagctaaggctgcggcacgaccattcttcattgcgttaaattgttgagtcttagaatcaaatttcaaaagatcaacatctggttgcttactggtgaagtaattttcagcagtggtacccttagttacgatcaccttttaacccttcaattggtttacattagtaattggcttagacttaggtgaaacaacaccaactgatactttcatatatggcttagcaaaatctacgacttgttttctttctggagtaacagtgaagttggctaaaacaatatcagccttgtttgcattcaaagtatcaacacggttattagcgtttacttgaacaaacttaactttaacgcccatttctttagctaattcacgagctaatcgaacatcatatccaacgcgcttaccatctttattaacccacccatatggtggtaaatcgccaaatacggcaacctttaaagtaccacgttttttaattgcagcaactgaactaggattgttgctggacgaactgctgcttgaattatttgagcaagcagttaaagttacagctccaacagataaaattccaacagcagcaattaactttttaataaatttatgtttcttcattttttactctccctaaaattccatactttctaaaaattcttctgctctctttgttttgggatgctcaaagaattctttcccaggtgtatcttctacaattgttccattttctaagaataagacctgatcagcaatttgctttgcaaagttcatctcgtgagtaacgatgatcatggtcatgtgatcttcatcagataattgtttgattagttccaatactcctctaaccatttctggatcaagtgaagcagtaacttcatcaaatagcattaaatctggatgaagagctaaggcacgaacaattgcaattctctgcttttgtccacctgataattgtcgtggatatgaatttgcatactgctctaaatgcactctttttaatagagcttttgcttctttttcaacctcagccttaggtctcttttgaaccttaactggaccaagcaagatattttctaagaccgtcatatttggaaaaagatcataactctgaaaaaccatcccaattttttggcgaagttgctgccaattcttggcagttggaattactttctttccttcaaaaataatcgtcccgctcttaaattcttctaaaccatttaaacagcgaagtaaggtacttttaccagatccagaaggtcccagtaatgttaatacctctcccttatttagagaaaaagaaatatcatgtaatacttgcttatttccataaaacttgtttaaatcttcaacttctaatattttttcagtcatcccttacgcctcgtttctcttactcaatcgttttgcccaaagtgataaaggataatcaacgatgaagtataagaagaaaatcaatccatatacccaaaaaacaccgttaggattagtttgattatttgcttcaacaatttgttgtccaacattgataacatccataacactgatcatcatcaataaagaggttgttttaattactcttgtagctaaattaattgttgcaggtaattctaattgaaaagcttgcggcaataagacatagataaataattgccatttattcaatccaagagctaagcctgattctcgttgaatttttggtaccgagatcaacgccccacgaacaatatcactaaattcagctgaaacccataaagcaaatgcaatcactgccatcacagatgccggccaattcaagttaaattgtctaggcaaaatataatagaacaagaacaataaaactacggttggcactattctgaagaattctagatatattctaaaaatcacttttactaagcgacttttcgatgttcttaaaacaccaaataatgctcctagtgccaagccaattattaaagaaagaactgcaatccaaacacttgtccagagaccacccagcaaacgggtaaagtttcttccttcgaataaaacattaatccccgaatgtcccatagcgaactctcctttcaagccaagttaataataaagatagtggaattaaaattattgcatacgcaattactaagacaaatagatattcatttgaatggtagtacaagccaatcaaatctaatgctgtattagttaattccggaatagcaattactgaaaaaattgatgtttccttgattaagaaaataatatttgcggcaattgctggaacacttaaggcaaagccttgtggaaagaccacataacgagctaattgccattttgacattccaattgcttcaccagattcaatttgatttttgctaattccatcaaatccaccagtgaaagcttcggccatataagctccacctaaaaatatcaaaccaattaaaccacaagtaatggcgctcatctttaatccaattaccggaaaagcataatataagaagaaaagctgaattaataacggtgtatttcttgcaagctcaacatatgcactgacgatcttatcaattacaggaacatgaaaatattgaatcaagctacaacagagcccaaccaccatcgctccaataattccaacaaaggacatccagactgttacctgaaagcctttgacaaattgtggcaaactttgctgaataattgcccaactcatattttcccttctttccaaaaataagtaactggtagtattatagacttactttaaatcagttacaataggtaagtgcattattttcttatatcgtagtattcatttttgttatagtaaaaaagacatacgccttcccctattcatctttagattcttctctaaaaacgaattggatttacgtatgtctttttaattgctgatactataaactactttatttattcttagatgtattctgatgtgaataccatttggatatactttctatatctcctgcatagaacattctaaaatcttttgcaatctctgaaacttttaatcctttttctacttcataatcttcgatatagttaggaataaaaacatgataaggaagagttattttaaattcatcttttttcttactttggcttataaagttattaacttggtcacttgtgtcagtttctctaaaagcaaaaattctagttccaattgggattttatccccacttttgcgaaagataggttcaacttcgtaataaactattactttcttagattcactatccgtatcattagctttttggaaccaattcatgactgcttgttcaaactggtgttgtcctcgttccttaccattacgacgatttttatcacaaaattgataagctatgtttgaacttacatttttacagaaaaaattgtcggttggttcattttgtccgcaaatatatttttgaaactcccgtgccactaaatgacctttgtctaaaaaagatgatttaggatccctattacctctataaaattttccgattaattctttagctgatcgtgtttcacacttattagataggagtacatcccattttataggcttatctatatctgaaagactcttattatcagataagtatggaaacattggctttttctcagaaactttacttttaatttcttgcataagatctgaagtttgagaatttatagtataaaaatattcatcttgatattcttttatctcgccatacttcgtgatgcagtttagatcttcatgtccaagagctttcattaattcactgaacttcataatttaatatcctattttcaaatgtttctatttatatcatatatacatatctaccatgacaaactttgataaaaaaataaaccgatataattatcggtttattggattttaattgtaccaaagagcgtccatacgaatgtcatttggtgaactttgtgttacacgaattgaagctttttgatacttttgaccatcgctgtttgtcatatcgttccatccatattggtctgccgtttctttagtatcttgtaaaaattcatttttacttgcattagtatttacataatgataattatgcaaagtcatatatgctgtgtgagcatctccaacactccaaggaatgtcatctgatgctgatccatttttcataatgtcgttggtaattgggatattacctttttggtaacctgctggagccatatatatatcccagaagacttgttccatttgaccagtagttaaagcttgcttactattgttaactggagtagctggttgaactggtttagcaggttgtacaggtttacttggagttgcaggttgagcaggcttagctggagtaactggttttgaaggagtcactggcttagctggttgagctggcttgcttggagttacaggctgaactggcttattaggagtagccggtttagttggctctactggcttagatggagttacaggctgtgctggttttgtttcagcaggcttagttggagtaactggttttgaaggagttactggcttagctggaataactggtttagtatcaacaggcttagttggagtaactggtttagatggagttactggcttagctggagtaactggttttacaggggtagtattatgagcagtattgttagtactgttgctactcttgtttccagtaacattgccttgatgtaattccttattagtatgagtagaattatttacaggtcttgaagtagaagcatggcgaatagtatcggaagacttgttagcagtattgcctacaacgctagcgtgatgaacttcattattttgtaagtttttagtattagtttgacttactgatacatattttgcaggaacccattgactttggttacctacacggtacattggttcatgattaatgtcagctttttcccaaactttccaagttgagttctttggtaagtattgactagtgtagttaccttggctgttaactaagcgaacattgcctgaaccttggtaattaatagtagcaacaccaacgtaattttcacgattataagctgcgttatttgctttacttgctacagcaacattttgacctaacttagcatctttccagtcagtgtacttagctggaatccattgcttatcagtaccgatacgatacattaactcatcgttgatataagctttttcccaaaccttgtacttcttgccattcttaacagtttgtttcattacgtgaccatcgcgatcatataagtgaacttcaccttgattttcatggtcaactacttgtaaaacgcctcttacttgtttagcgtgagttgcagatgtagcagcttgtgcttgagcactatttgcaaataatccagcacctgaaagaatagtagctgaaactaaagcagtttttaacaatgactttttattcataattttaaaatctccttatctaacttataattttgattttcgattctttaaaatgactaaatagaatttatcaccacctcttaattagaaacattattagaatctttaatatttccttcttgatacttatttttcaagtatccgtatttatcagctctcttaaaggccttattaaatacaaagaaaataataataaagccaaaaaataaaattagcatatcttctactacatactttacaaatcccaccatcatataccgaacataatcagtggaaaacttatttctctctctaaaactcgcgtcttttttaggtgaatcatcatagctaatccaatacgtaatggtattattttcaggattatactgagcactagttaccgttttttcaggcgtacgatcataagctttcttagcatccctattacgtttaacataagctctcccaaaactttttagccaccacattgtgaaatgtccaaaacgtccatgccatgctaattgaatccacggaaaggtaataacaccggaacttaggataaacaacaataaaattgtacttgggagacgatatggatttaaaattataggaaacaagattattaagaagaaaattgcatatatggttcctagcgtaaatacgtaaaaataccactttaaactaagtaatctttcaaaaaaactcacacttaccacctataaaatttaattactaccaaattcatgattaacgagtctgattccatctttacgtgccctatcattaggcatatcaatttttaaaaccattttatttccactttcacgagaaagatcaagcctcgacttcacataattaagttcatcaatcgctttatccattttgctttcaccaatatcggatttaactggccgatagtcatctgaatcgtattcccactttggattatcttcgacatacttaatagtttgactacttgcgccatacttttttaatatggatgctctaattttacttgcaatccgatctcggtctttatccggaacaaaccaagaacccgtatacgaattccatcccacttgttgaacaccatctaatggatcaacaagactagcctctctaattccaaataaacatatcagaaccaagaagcctcctagaaccgaaacaatgatcttatgcttagaccaaattttcttagctttaataacaaatttattttcttttattttatccatctattttcgaccctattcatcgtcactattatcatcattgttactatcaatagagtcagaattcttagctgctgcttgaattacatcatttggaactgcaattttttgttgattgatattagtgtaagaagctgttcctttatttgaaccagcggtccaatcataatgaatctcagttaactgtttttgtttattaaagctataagttagagtagctgatgtaaagtcttggtctccaaatggattccatttattttcacttgaaacccaaacaatataatgttccattaattctttagcttcagcagagtttccctcatattttgcttgataaccatcactagtttttgagactttcatttgattaataaggggagatggaaggctaatcatcggatcaaatcttccaatcttataagtttgcccaattttagtccatttatcacccgataaactgtagacaaattgatcagttgcccaaacctctgagttcatcccaccgttgaacttataatgtactactcgtggattttcttgaattattcccgtgtcataacctttaacagttgcataattaagccgaatatcaaaattaccttcattaaaggccgaaacattattcatcaattcagtaactgttggtactttttctacatctttcttcgaactacttgccttattaaccttctcactgctctgttttttcacttcaccttcttgcttttccgacttgctactcttagatttacttttcttttcaatcttaactattgaagatttcgacttggcattagtcttagatgtacttgattggttttcattactttgacaaccagctaatgctaaggcacttacacctactaaagcagcaatcccatacttataagacttacttttcactctatttcctcctacactcgagctattagaattaaaataattgaagacgcaaaaaagccaagctaaagaatgaccccattaaagtcatctttaacttggctttttatgtactgtacaagaaaataaggatttaaagtagaaaatcccttagaaacgttgatagaatggctttctaccccccccaatcagagaaatgagagtattgtttcttaattcttgcatagtaacacctccaacttatgaatttattgtagcatattttttgttattttaaagcataggtagttcaattttatagcaaaaaaaccttgcggtaatattgctattaccacaaggtttttgctgttaattcttatcctaatctaagaagtcttttaattgatttgaacgacttgggtgccgtaacttacgcaaagccttagcttcaatctgtctgatacgttcacgagttactccaaatactttaccaacttcttctagagtacgagtacgtccatcatcaagaccaaaacgtaaacgtaaaacattctcttcacgatcagttaaagtatcaagtacttcttcaagttgttcttttaacaattcatatgaagcatgttgttcaggactagttgcatctttatcttcgataaagtcacctagatgagaatcatcttcttcaccaattggtgtttcaagagaaactggttcttgtgcaattttcaagatttcacgaaccttatcagttggcatatccatttcggcaccaatttcttctggagttggttctcttcccaaatcttgcaaaagttgtctttgaattctgatcaacttattaattgtttcaaccatgtgaactggaatacgaattgttctagcttgatcagcaattgcacgagtaattgcttgtctaatccaccaagttgcataagttgaaaacttaaatcctaaacgatagtcgaatttgtcaacagccttcatcaagcccatgttaccttcttgaattaagtctaagaaggacataccacgaccaacataacgtttagcaatagaaactaccaaacgtaagttagcttcagctaattcttgcttagcttcttcatcgcctgattcaattctcttagccaaggcaatttcttgatcggcatttaataatgaaacacgtccgatttccttcaaatacatccggactggatcattcattcttacgcttgaaggtgctgacatatcttttaattcagccttctcaacgtctttttgcttctttaaagctaattttgaaggttcaccattttcatcaacaatactaattccattgtcttcaaattcttgaactagttgatctaccgcttttccttgaagatcatatggcttaattagttgagcagtaaattctttttcagtaatttgtttgtcttttttaacttccttaacaacttccttgacctttttatcaagtgtcattgttgtttctttggtagtcttactctctgccatgtaaaaaagccccctctaaaacttctttcttcttaacgcaattactttttgcgctatttcaagctctaaactattgtcttgttttctttgagcatccttcaattgattaagcaaatcatttaattgctgatcaatcttacttttttccaatgcccgcaattgatcatctaattcgcgcttagaataatctggaggcattgaaatcatctccatattaataattataccttgaagttcttcaggaataaaatcaatgaagccagtaacctctgccccttcatgagtctgatggtattttaaccaaaattctgctaactttgcataacgttcatctggaaacaaaaattgctgactcaataagtaatcccttgcttcatcactgtgtatgaataggtaaagcaagcgatcaagggccggattccttgtctcaaggtcagtacctgcttgctcttctttcggctcactaggctgatctattggaagtgatttaggagcttgataagcttgctgatgattctttgcacgctgtaatttacgtctttcacgcacaaaagttacttttaatgattcacgagtaactccagtttgacgtgctaatttatcaagatacaaatctgccgcaactggatcattcaggccagcaatcatttgtacactagccgtaatatatcctagcttctctcgatcattatgtaaattatattgattagccaatctttcaagtagaaaatccattgagctaagtgcaccagcaacctctgtttgatatttctctactccatatttctttacatactcatctggatcgagattttcgggtaaaacaattattcctaaattgaatccctgtacttgcccaaatagcttcgttgctctttcagcagcatgaatgccaggcggatctccatcatagttaattaagatattgggagtgattcgtctcagcatatatacttgttccgtggttaagctggttcccatcgaagcaacaccagactgaataccagccttataagcagcaattacatccatatatccttcgtaaagaattaaatgtttttcacttcttgccgctttttttgcttcagcaaagtgaaatagtaatttagatttattaaaaattttggtttctgggctattcatatatttagcaatagttttatcattactaattcgtcgaccagaaaatcctactgtataacctgattcatcccctaaaggaaatattaatcgatcacgaaaacgatcaaatagttgtccatcttgtgattctacaaataaaccactttctcgcagttcatcatctgtataaccttcttgacgaagataagttaataaaattgtatcgttatcaggcgcatatcccaccttaaaatgctctaagaggtcactagttaattcacgtttttgagcatattcaagtgctctttcaccaactttagtggttagcaaaatatgctggtaaaattctgttgcttgccgatacatcttctttaacgggctaagtggctttaccgtttcgccgtagccttctggcatatgaagatgggccaattcagcaacttttcttacactttcaggaaaagtcagatgatcctgatacattaagaatttaaatacgtttccgcctttaccacatccaaagcacttaaaaaactgctttccttcattaacagtaaaagaaggcgttttttcttgatggaaggggcaaagtcctaaataatctttaccttttttttctaaagagacatattgacttattacatccacaatatcgacagagtttctaacttcatcgataaattgttcaggaatacgtcctgccatcaatggatcatcccaatcaactattatttaattactaatttacttaagtcacccattcgatcagctaagttattaacctttaataattgagccaaacgattattctttaccttttcatccttatcaagaatcatattgctttcaaagtaattattaattactggttgtaattctacaaagcctttataaagatcggcaatactcaaatcagtattttcctctaatgcatttacaccagcatacaattcttcttcactaacatcttggaaaagactttcatcaatgtcattagcatttctatattttgctttcttcaaaatattagtaattctagtcaagctttcaactactggcttaaagtcagcatcatcatgatgcatttgcaaggtcttagcagcagccaaaatttgaattggatcttgctgactagatgcaagaacagcgtcaattacatcatagtcatatttttcaacttgtaattgttgctttacacgatcacgaataaagtcggcaatttcattttcagcttcagcatccttaggtaacttagctgcggtcttacctgatagtaattgaatcaattctggtaaaacatccttaataggaagtgaccaaccttcgttcaataagattcttacaattccgtatgcgtttcttcttaatgcatatgggtcattagatgaggatgggatcattcctgcaccaaagaatgaaatgattgtatcaagtttatctgcaattgaaagtaaggaacctacagtagtacttggtaagtcgccttcagcactagttggcatgtaactttctttaattgccacactaacattttcattttcaccaattaagcgtgcatagtgcattcccatgacaccctgtaattcagcaaattcaccgaccattgaagtaacaaggtcaaatttgtagatatcactaactcggtcaaagtctttcatttcagtatctgaaacattaaacttcttaccaaggtaatcaccaataatttgaacacgtgccatatgttcagctaccgaaccaatcttatcatggaaagatacgttcttaagcttatcaacgaagtgagctaatgggtacttcttatcttcatcatagaagaattgagcatcatctaaacgagcaacaagaactttttcattaccagcgatgacattatctaagtattcactatttccatttctaactgaaatgaagtgattaattaatttgccgttttcatcatagacttcaaaatatctttgattatctttcattgaagtaattaatacttcatcagggatgttcaagtatttttcatcaaaagaaccagcaaatacagttggatactccaccaaattagtaacttcttcaagtaatcccttgtcaatattaactttccagttatgttgagcaacgagttcttgaatttggttaagaatcatacccttacgttcatcggcattagcaattacgtattggctctttaatgcttcttcataatcatctgcgttagctaatacaacactgtcacctaagaaacggtgaccttgagttttacgaccagctactacatctagtaacttaactggcactacttcactgccaagtaaagaaaccatccaatgaattggacgaacaaattcgaagtcgtagctaccccagcgcatcttagttgggaaagtcattgctttaacaatatcactcattcccattaagatatcagaagcttttttaccttctttttgaacatgaacataagcatattcagtgcccttaagctcttcaaagtaaatgtcatcagtagtcatcccttgaccacgaacaaatccttgagcagcttttgtccaattgccatctttatcttgagcaatcttcttagctgggcccttttttacttcatcaatatcttcttgtttttcagctaaatcttcaactaaaatcgttaaacgacgtggagttgaataagtcttaatatctttaaaggacaaaccattttcctttaaatactttttagtacgatcagctaattgcttaacacttttagaaacaacgtgagctggcatttcttcagtgccaatttcaaataaataatctttagtcattgttttgccccgctttcttagtttcttcttggtgctttaataatgggaagccacgtttttcacgttcttcaacaaatcccttagcagcaagatgagctaagtttctaattcttgataagtaacccgctctttcagtaactgagactgcaccgcgtgcatcaagcaagttaaaggtatgactacattttaagatgtaatcataagctggatgaattagattttgactcaacaagcgcttagcagtagcttcgtaaatatcaaagaacttaagtaattgttcttgatcactttcttcaaaagcatacttagaatgttcatattctggttgcttgaagatatcacgatacttaactccatcgccccattccagatcaaagactgagtttacatcttgaatgtaagaagcaagacgttctacaccataagtaatttcactcatagttggtttaacatcaagttccccaactacttggaagtaagtaaattgagaaacttccattccatcaagccatacttcccaaccaacaccggcacaacccatagatgggtttgcccagttatcttcaacaaatcgaatatcatgttcaagaggttcaatacctaatactcttaaactgtctaaatagtattgttgaatgtcctttggtgcaggcttaataactacttggaattggtggtgttggtataaacgattagggttatcaccatatcgaccatctgcaggtcttcttgaaggttcaacataacaagctgcccaaggttctggtccaacagcacgtaaaaatgtatatggactcattgtcccggcacctttttgttcatcatatgaaggcataatcatacaacctttagaggcccagaactgttccaatttaaaaatcatatcctggatattcagtttttctgacatctatctctctcctcacaacataggcataaaaaaagcctatgcaaaaattgcatagggacgatttacttcgcggttccaccctaattcaggaaaatattcttcctgcccttaattaacaactttgactaaaaggtgccttttcccaaatgcacttccaccattctgcactcgctgtattggtacttttctattcctttatagttgtcaaaatacgtatctattttatcatcttttacaaaaaaagactagtaagaaaacctcactagtctttaaacgaatataaaaagtcaacagctaaaaaagcgccaattcatcaagaaattttttagtttttaaattaagatccagatagttaacgtacatccgatcgatcaccttgccagagtccttttttaattgcggattaatttttattttccctaaacgatcaatatcaactaaagctagagtacgaatcaaggctactactttaggatctaaatgcatcctttgactgacactattaaagtgatcactacaaataattccacctaattccaatgagtagtcaaacttaccttgtactttaccacaaattaaacaacgatctaattgtggcgctactccatatgcattaagcaacttcaattgtaccatctgggtaataattgctgcatcttctcctgaatttatcttcagcaacgcttttataatcaaatcataaaaacttccaatatctttatattcaacaaaagcatggtcaagcaagtctaaaacataactcgaatacgcattcttcgttaaatctaaatataactggtccagctgctttacatccttgaaagtccgcagcgtactgattcctttccaatttgtatttacaatatactttccataagagaagttaagggttgcagctcctaatctggactttggtctcagtgctcctcttacatctattgtaaaaataccatgatctttagtcatgatcttggttagaacatcagcttctttatatttttttcttttaaaaattaatccttgaacttcacaaagttcacgtgccatctatcttaattccttagcgttgtagccaatagatttaagaaaggcaggatcggaacgccaattcttttgaaccttaacccataggcgtaaattaactttttcacctaataaagcttcaatttcctgacgtgcagcaattccaatctgcttcagcatttgacctttcttgccgataataatgcccttttgaccgggacgctcaacataaattgtagcctcaacttgaagcttgccaccttcatgatcccgcattcggtcaactaccacggccgtagcatgcggaacttcttcatgagtgagcttcaaaacctgctcgcgaattaattcagctacaataaaatattctggacggtcagtcaattggtctgcatcataaaattgcggaccttctggcaaatatttagcaattgttttaatcaactcggaaacattatttccttgtgaagcagaaattggaacaatttcagcaaaatcgcctagattcttatatgaatctataatagataataactcatctgggtggactttatcaatcttatttatcactaaaaatacaggctttttaattttcttaagaagttcagcaatatattggtctcccttacctgctggttcaggttcaaccataaataaaaccacatctacttcatctaaagcagagtaacttgacttatccataaagtcatctaatttattttttggcttatgaattccaggagtatcaataaaaacaatttgctcctgatcatcagtataaatacctgaaattttatttctagtggtttgtggctgtggtgacataattgccactttttgccccactaaataattcaagagagttgatttaccaacattaggtctaccaattaaagctacaaaacctgatttaaagtctttcttttcatccatcattgttacatcctttttaattaagttttagtgaatttgcttcccgtgattttcttgatcaggatgaagcggaagtccatattcacgtaaaactttaccttggataccaaacatcaccttggcttcatcatcttcgatatgatcataaccatttaagtgaaggtatccatgaactagtgtatatccaaactcccgattaaatccagtttcatactctacactatgtcttttgatgacttcagggcaaagaaataaatccccaatatcttctacaaaatcaggatcgtcactaaaagcgctaataaagtcttcatctaatccatcttcaattgcaaaagaaattacatcagttggacgatctttgccgcggtattttttattgatttcatggatttttttggaagaaacaaagttaatactcatttcttgagtattctctttatgaatctctttttttgctgataataataagttgctaatccatgtaatccaatctttatcgctatcttttaagaaattaacttcatcattaaaagaaatatctaaattattcaactcttagtgtccctcttcttcatatgctctaacaattttggccacaacgggatgacgaacaacatcattaaaagtaaagttaataaattttacttgctcaatattctgtaaaatatgttcagcttgtaataatccactctttgcttttcctggtaagtcaatttgggtctggtccccattgacaaccattttagaattaaatcctaatcttgttaaaaacatcttcatttgtgcctgtgttgtattttgtgcttcgtctagaattacaaaagcatcatccaaagttctaccacgcatatatgctagaggagctacttcaataaccccacgttccattaaacggttggttggctctacacctaaaatagcatataaagaatcatagattggtcttaaatatggatcaactttttcttttaaatcccctggaagaaatcctaatgattcgcctgcttctaccgctggtctagtcaaaataatccgggacacttctccttttttaaaggccgcaatcgccataactacggctagaaaagtctttcctgtaccagctggcccaattccaaaaacgacatcatatttttgaatagcttcaatatagcgtttttgtcccatattcttaacgcgaactggacgacctttagcatccctaattagaattttattatataattctccaaaaaattctaaagttcccttatctgccatcttaattgcgctaacaacatcagttgcagtaatagtaactccacgggtaacaaccttatccaaagcagtaaaaatttgcataattttcttaacaatgctttcttctccggttacttcgatttcactaccagtatcagttacctgcacatcataagattcttcaattaaacgcaaatttgcatcgttaattccaactaaattcatgattgtttctggtttagttggtgtaaatgttgcttctatagtagtttgtcccacttaaaatcctccgtttaataaaagctattagttaagctttttaccaacaattgaagaagctgctttaccatcagccttacccttaatttttggcattaaagcttgcataactttaccaaagtcttttttagaacttgctccaacttctttaattgtttcttcaacagtttcttcaagttcttccttagacatttgctttggcatgtatttttcaattaatttcatttcattctttgtttgattaattaaatcatctctgccagccttagtaaattcttctaaagattcttttcgttgtttaagagcgctggacaaaactgttaattcatcatcactagttagatcatgtcccactttaattttataattcattactgccgccttaagcgagcgaattgtagttaaagctcccttatctttggctttcatagctgttttcatatcttgcattaaagtatcatttagtgacattgtatttaattctcctctttaatcaaaacttacacagtctattttaaactttttatataaaaaaagctcttgatagaagaattttctaccaggagctttttctatattaataatgtctacgcttacgagcagcttcggattttaactttctcttaacgcttggtttttcgtagaattcacgcttgcggtattcttgcaaggtaccacttctagaaacggaacgtttgaaacgacgaagagcatcatcaatagactcgttttcgtgaacgattgtcttagccatgtgagatccctccttccatttcttggcacacaaatatgtgccacaacaatatagttaaattatagctaaacgagaaaaaacggtcaatagtcgattaacatttttcttacttattttggtataatttagataattaatgaggtgaaatatatgactgaagaaaaaaaagaaaatcaaaaaattgttaatctaattattatttctgactctgttggtgatacagctttcaatatggtacaagctggtgcggtgcaatatccaaatgttaagtttaactaccgccgctatccttttattacaaatcgagaaaagctagaaaaagtttttagtgaaatcacagaatttgaaaatgtattaattgcctttaccttgattcacgaagatgaacaattggccgtaattaaatttgcacgtgaacataatatgaaatacgtcgacttactttctggcgtaattgataacattcatgctttaactggcgaagaacctaaacatgaaattggtgctgtccaccacatgggtcaaaattactttgatagaatttctgcaatggaatttgctgttatgtatgatgacggaaaagatccaaaaggtttcttagaagctgacgttgttttacttggtgtttctcgaacttctaagactccactttctttattcttagctaacaaaaatcttaaggtcgctaatttaccacttgtacctcaaacccatattcccgatgaaatctataagattaatcctaagaaaatcattggtttaacaaatgatccgtccgttttgaacgagatcaggcgacaaagaatgatagcctatggtttgaacccagatactacttactctaatatggattctatcaatgcagaacttgaagcagctgataaactttataaaaaacttggttgctatgtaattaacgttgctcatcgttcaattgaagaaacagcagcactaattttagaacacctcggtattgatgactacgctaagtaacaaataaaattaaatattttaaaaagatctttcattaaattttgaaagatctttttttgcttctattattttttatcatatccaaaatgttttttagcctgatcactcattttctcaggactccaaactgggtaccaaacgaactcaacatcaacatttttgacttcaggaaccttcataaccgcagcattaactaattcaattaatacttctgttaaaggacaagctggagtggttaaagtcatattaattagacaaattccatcttcatctaagtcaagctcgtaaactagtcctagattaacaatatctacccctaactccgggtctatgacagttgctagttgattaataatattttgtttaatttcttcactagtgcgcattttaaacatcttttccaaaaattctagccttaatagcctgtcctgttggagtgcctgctaatcctccaataccagtttctcttaatgctactggcatttgatggcctacttttttcattgcttcaatacactcatcagctgggataacactagtacatccagctaatgccatatcagctgcaattagagcgttcccagctccaattgcatttctttttacacagggtacttctactagtcctgctattggatcacatactaatcctaataaattagacatcgcaatcgctaaagcttgggagctttgcctaggtgtaccaccagctatttctacagctgctgctgcacccattgcggacgctgaaccaacttcagcttggcatcctccggttgcaccagctatttccgcattatttccaataactaatcccattcctcctgcagtaaagagaaagcgaatcatttgctcttcatttaagtcgagctttttttcaagcataaataaaatacctggaagtgtgccagaagagccagctgttggggttgcacaaatgacgcccatcgcagcatttacttcatttgtcgctacggcattttgcacagcttccatcataaaatcaccagaaagagtatgacctttttcacgataattctttattttaatcgcttcaccgcccgttaagccagtatgagaaaatactcctttaccagtacttcccttactaaccgcagcacacatggtttcaagattatatttcattttattccatactttttctcgtgataatcctgataatttgcgttcttgttcaattatcaattctgaaataggtttttcttgtttttcagcgtctgcaacaatttctttaacatgattgtacattagtttctcatttcataaacaaacaatgtttttatattttttcttgagttctccaattaaagaaagcttgaaatagttttgaatatcatattcatagatgtagtattcagggcttttataaattctgctttcattaaaaggtgccttttgttgtaaaaaggaagttaaggatctttgattttttatttttctttctgggtcaatcaataaaacaattggtaacgtaccgcttggctcaaccacaatatcgtggattactaggcgtcgaatttcgattgccccaccaccaatggaacagcctgctaattgaacttttttatgaccgttagtcatatctaaaatcgccgtatttgggtgatgaatcgggctttctcccttttcctctacaaacctaatatcaatgccgcgcttacgggcaatctccggggcttttggtactcgtaagtcagaagtagtaaagcccaaaattcctgctgcaattgcataatcagtaccatgtccacgatgagtttgagcaaaagagccataataatgaacagtaacctttttaggaactcctccaaaaagtttgtttccttctctgccaattgctactgcaccagctgtatgtgaactagaaggtccaatcataactggaccaatgatatcaaaaacacttttaaaacgattttccatgttagatttccctatataaaaatatttttaaagaaaaacgaccatttcctttgttatataaagtgaaataatcgttttctagtaacatctaaactggcgtctgttctttgaatcttccatataccttcgaaacttcgcttaaactcatgaaggcatacggatcattatttaagacaatattataaatgtcatacatatcatatttatcaattaccattaataaaactgtcttttcagtatgactatatgcaccctcggcatcatgcaaaatcgtaatcccacgatgcattttagcctgaattccatcaataatatgtttaggatgttctgttacgattaagacttgcatcttttgatgttgattatagacagcatctattaccttaccattgacaaagatgtttaaagccgtatatagagctcgagtccatccaaatacaaaaccggcacagattacgataattaggttaaaaaagatatttatttgaccaaaacttttaccagttttctttcgtaagataattcccaagacgtctaatccaccggtagagatacctgattttaaagctatcccagtaccaacaccattaattactccaccaaaaattgcacaaataattggatcatagctcatcttaattggagcaataattttcatcataatagatgccaataaaactgcaattaaagtaaaaatcgtaaaacggtggccaattttaaaccatcctaaaataaataatgggatatttagtacaaaatacattactgatgtagctaatgtaaatggcaaatatcgttctgataccgactgcaaaatttgggcaaaaccagtaattccagaagcataaattttaccaggttgccagaaaaagtttaaggcgatagcaacggctaaagcataaaacaaagctgctgataactttgaaattaaaatatggcgtcgcgaaagcctttctaatgtactcataattttcctcttttactatgtttataacgtatctagtgtaaagatatttatagttaaaaacaagtctattttttccaatgttctttgataaattgttctctccctcccgcttcttctagagcataacgagctggatcttttttatagaaatcttgatggtaatcttcagccaaatagaaaggctttgctggttcaatacgggttacaattggatctgaaaacttatttgaatctgctaaagatttacgtgattgttcagcaatttctttttgttcaagtgaattatagtaaataactggttgatattgactgccacgatcttgaaactgtcccatagcatcggttggatcagtaacttgccaataaatattaactaaatccttataagatagtttatttggatcataagtaatgcgaacagcctcagtatgcccagttaatcccgtacaaacttgttcgtaagtagggttaggcacgaccccacccgtataacctgattcgacctttatgacaccaggatatgtatcgaaaggagcaaccatgcaccagaaacatccgccagcaaagatagctgtgtcatagtgcgaattttcattgatatcaagggatttaacgtctttcatacttttcactaactttctaaaaaaatcaatatttatcaaaattgtggtactttttaggttcctatttcttttaattcattcatatatattattaatggaaattacccttaaagcaaaaaagtcactctagaacatcagatctaaaataactttctttttatatttacttgctttcctttaactttgcttttctttcctctatataactttctatggcttttaaatcttcttcagtcgccaacttaagaataaagttctttgtagtggatcgtttaactatgtaattctttctagctttattattttcatcccattttttattagctttttttctagcttctgttagtttaatcattaaatatcatctttctaatcaaatataaaacaactctaagtgatattgtatattgctatgataacagatttatagtttctttcttagtcataatatttagctttatagcctacaaggctgttaagtgcatcgattagccagcgtttatattaaatctattttcaaaacaacactttacataattattttaacgtaataaatataaatttattttatctgcaaaagaataaaaaaatccatctcttgattatataaaatcaaaagatggattttaaataaaactaattttcataaatatcattaagcgctttttcaaattcaggaagccagctcattttatatccagcacgagtgggatgaatatcgtcaaccatatagagttgacggtctttttcattgtaatcaaagcgcttgtcatcccacatattaagaaacttaaatttccattttttttgtaattcttttgttgcttctactaatttaccatatttttcagaatcaaaagatggattagaataaatcaaaacaggacaattccaagtctttttaacatattctaaaatgaattcaattgctccaatactagttgtaatatcatatttgtcactttcactaattttacctaaaggaatatcagctttagcatcattagttgaaagttgcaaaacaaacgcacttatattttctaaaattgggagtttctctaagcgcgccacataagaattatcaccattttcagctaaggttgttcctgaaacagcttctttaaatggataaatcccatcttttttccttaaataatctacgaatgattcacttaaggcacctgcaccataagtaacagaacttcctaaaaaggcaacctgcttatcttgaagcttactattggtagcctgagtcgcacttacactgtattcaacctgattaccagaggctttaactatttttgtcaaaaagtcttcatgttgaccagcaaactctaataattcaggaatattttcttctggaaccttcaaattatcaaaaacttgtattaaattcatgatcctattcctcaaatatttttttatattgattatagccttcctcttctagcttatcatatggaatgaattttaaggaagcagaattaatacaatatcgtaagcctccctgatcaactggtccatcagtaaaaacatgacctaagtgggaatcagcaatggggcttttcacttctgttcgctccattccatgagattgatcccgtttataacttaatttttttattggcttcgtaaaactcggccaaccacagcctgcatcatatttatcttgacttgaaaaaagtggttcaccagaaactacatcgacataaattcctttttggttgaaatcgttatattttccactaaaaggcatttcagttgctgcatgttgtgtaacttcatattgctcagaatttaattttttaagagcttcttttttatcgaacattttttcaccttctaaaattaaagatatcaaattttaacataaaaatgttgtctcatgatttttgtttctatacaataatctataatattagagggggattttttatgccaaaattatcaaatgatttatcacttacaaaaaatacacgattaaattctttaggaccttcaaaaattagagcttttgatgaaaaagcttctcaaatcccaggaattattaaattaacgattggagaacctgacttaaatacaccagatcatgttaaagatgcagctattgccgatattaaagcaaacgactcgcattatgcaccacaagcaggtaagcctgagttattagaagctatcagcaactatctcgatcgcagccttgatgttaaatacgatccaaaaactgaaatttgtgttacagttggagccactggagctttaaatgatgtattcatgtcaattttaaatccaggtgataagattttagttcctacgccagtatgggcactctactttcaactaattaaattaaccggagctatcccagttcaaattgatacttcaaaagatgattttatcctgactcctgaacatcttgaaacagtactacaaaatgaaggaaaaggtgctaaagcaatcattttaactgatccatctaatccaacaggtcgtgtttatccagcagccactttaaaggcacttgcagaggttattaccaagtaccatctcttctcggttacagacgaaatatatggtgaattggtttacgataataatgttcatcattctttatctcaatatattcctgagcgcaatattctaatttcaggactttcaaaagcatatgcaatgactgggtggcgtttaggatatattgcagctcctgcagatattatgaaaaccattcaaaaagtaaatgcttttcttgttacctccgtaaccgataatgttcaggctgctgcaattgaagcactaaataatggacaagcagatcctcttgaagcacgcaaaatttacgaagacagattggaatttatgaaaactggtctagaaaaattaggctttgaaatgtctactccacaaggagctttctacatttttgctaaaattcctgatacttttggtaccgacgacgaagccttcgctaatgaattagccactaaagcaaaagttggtgtgactccaggtcgctatttcggtaagggcggccaaggatatgttagaatgtcttacgcttcttcgaccgaacaattacaagaagccttaaaacgaattgcaaaatttgttgaaaatatctaaataaataaaaaattgcattacctgctttaaaagttaggtaatgcaattttttattactcaaatttttaactaagattattcatcccaagttgagttcttatcggcatcttcttgagcttctttttcaagacgttgttcagtttctttaacactatcttcatattgcttttcaacttcaataccaatgtcagctaattgttgatcagcaactggagctggagcatgcatcattggctcagaagcagaagcattctttggaaaggcagtaacgtcacgaatgttgtccttacctgctaacatcatagctaatcgatcaagaccaatagcaagaccagcatgtggtgggaatcccatatctaaagcatccattaagtaaccaaattgttcataagcacgcttcttagtgaaacctaaggccttaaacatcttttcttgaattgaacgtttgtggatacggattgatccaccacccatttcatctccgttcataacaatatcgtatgaacgtgcatgagctttatgaggatcagtatctaacaacttaataccttcgtcatctggcatagtgaatgggtggtgagcagcaatccagcgacctaaaccttcatcatactcaaacaatggccagtcaactacccatacaaagtcaaagacaccttctggaataataccagtttcatgagcaaattcacgacgtaggtgatcaagtgaatcggtaacaaccttccacttgtcagcaacaataacgattaattcgccgccttcaagatcaaattctttcttcaaagcttctttgttttcatcagttaagaaacgagcaataggtcctgaaaattcgccatcttcatatttaacccaagctaaacctttagcattgtagcgcttgatgtagtcttgtttttcttcaatcttcttacgtgaatattctttagcaccattcttaacagcaatacctttaactacaccaccatcagcaattgcaccagagaataccttaaagtcactatctttgaagattgggcttaaatcatgaaggtacatttcataacgagtatcaggcttgtcagaaccatacttgttcattgcttcgtcccaggtaatgcgcttgattggagtctttaaatcgatgttcataacatctttcataatcttctttaaaagaccttcagtatagtcttgaacaccttgttcatctaagaaagaagtttccatatcgatttgagtaaattccggttgacggtcaccacgtaagtcttcgtcacggaaacaacgagctaattgatagtatttatcaaagccagcacccattaataattgtttaaataattgtggtgattgtggcaaagcataaaaactacctgggtaaattcttgaaggaactaagtagtcacgagcaccttcaggagatgatttacctaaaattggagtttcaatatcaataaagccttgttcatcgaagtattcgtgaactgccttcaaaatctttgaacgtaaaataattgctctttgaagagttggacgacgtaaatcaaggtagcggtacttcaaacgagtttgttctgccgcattaatatcatctttgatctcaaatggtggtacttttgatttgtttagtacgtcaatttcagtagcatctacttcaacttcaccagtcttcatttctgggtttacacttgaacgcttaactacttttccctttacttcaattacatcttcattattcaatgaatcagcaatttccattaacttttcaccggaatctttgttaacaacaacttgtacgattccttcacggtcacgaaggtcaatgaaaactaagtttcctaaattacgaacacgttgaacccaaccataaagggttacttcttgtccttcatatttgctagtaatattaccagcgtaatcagttcttttgtccatatgttccatgttaatcctccaatttatttataacatcttgcatattatttatatcttctaagctaagatcgatagttttaccatcacttaaacgcttaatatttaaaacgccattttctaattctttagctcccaaggtaattacaaatgttgcatgaacgcgatcagcttttctaaactgttgtttaagcttcttttggtcaacatcatattgtgcactaaagccttgttcacgtaaactacgtgcaacttcaacagctttaaactcagttcctgcaccaatattagtaataaagaaatctattccttcttcttggaaaaggtccggattttgctctttcaatacaagcattaatctttcttccccaataccaaaaccaactgcaggtgtttctggtccatcaaactcttcaactaagtggttgtagcgtcctccacctaaaattgtcgttgctgattcccatagattcttatcttcaaccatgaactcaaaaataattccagtgtagtaatcaagaccacgaactaaatcatcatccattacatagttaatgcccaattgctctaacatatcagtaattgttttaaagttttcccgagattcatcatctaagtaatcaacaatcttaggagcattaggtaaaaacttcttatctcgttcatcttttgaatccaagattcttaatggattttgacttaagcgacgttgtgaatcttcagaaagttgatctttaactggtgtaaagtaatttaccaaagcatcatgatatgcttcacgaacttgagcattacctaaactgttaatgtgtaattcataatttttaacacctaattcagcgagtaaatcatgtgccatcattaaagtttctacatctgctaatggactatcagagccaaaactttcaacaccaatctggtggaattcacgttgacgaccggcttgtggtctttcatatctaaaagtattgtcaatgtagtaaacgctaaatggctttacaacatctggtccataaagcttattttctacgtaagcacgcactacaccagcagttccttcaggacgcaatgcaatgtgacgaccacccttatcgttaaagtcgtacatttcttttgaaacaacgtctgaagtttcaccactagaacgtgaaaaaacttcataattttcaaaactaggtgttcttatctcacggtaattagctcttttaaaaaagttcctagcaatagattctactttttcccatgaaccagattctcctggcaaaatatcgactgtaccttttggtctttgaactttcatttaatcatcctttaatatattaataaaaaagcgcccttgaactgagtcaagggcgcaataaattagcacggtaccaccttttgcttgctgcgattaacgctcgcgaaacgatccattatctgctaaaggtgtcacagatcgcaacctatccgctattctcaccaaacaagcggtctctgagatagatcatgctaatctacattcttcgtcatcgataattcctttttagcttatatttttcagtcaacaaagtcaacctttgtaagcctttacttaaatattttaaatgtctaatacaattgtaaagggaccatcattttctaaactaacctgcatgtcagcaccaaattcacctgtctcaacatggaagcctttatcctctagttcatgattaaagtcttcccataattgttttgacttaggtggacgcatagcttctacaaaacttggtcgatttccctttttagtatttgctagcaaggtaaactgactaacgcttagaatttcaccattaacatctttcaaagataaattagttttaccatctttatcttcaaaaatacgtattttagcaattttatcagctgcttttttaacttgttctaattcatcgccattccgtaagcccactaatagaagaaaaccacgcttaattttacctacgacttcattatcaatagcaacttgtgccttatttactctttgaataacaacacgcattaattaattgacctctttgcttcataaacatttggcacatccctcattcgacttaaaatatcttccaaatgagctgcatctctaactgagacagttgcataaatatgagccatgttattactatctacttttccagaaatattgacaatattcttagtcttagaatttagggcattgattacatcacttaagagacgagaacgattaaaaccataaatttcaatgtcagcattatagttttctttattcttgtctttagcgatattttcccaagcaacatcaatcagtcgaccctgctttttagcttcttcggttatattcggacaatctgcacggtgaatagttaccccgcgtcctttagttacataaccaataattggatcaccaggaacaggattacaacatttagctaaatgcagcattaagtcagatacaccctggaccataaccccattattatgcttaacacgcataatatctgctggagcatctgaatcgttatcttcttcagtactttgctgaccagcgttcatgattttctcttcaagttgacgttgcttttcatcttcagcctttttacgtaaatcttcagttaaacgatttgcgactgttgccgcagaaacttcaccatacccaactgcagcaaacaactcttcatcgttgtgatagttgaaatgatcaataactcgctgaacatcagctttagtcatgaattctttaggaactaaatcacgatttgataattcttgttcaatcatgttttgtcccttttcaatgttttcttctctatcttcagtcttaaagaagcgcttgattttattacgagcacgtgaagttttaactaagttaacccagtcgcgagatggacgagctgatgcttgagttaacatttcaacgatgtcaccagtttttaatttgtagtctaggggaacaattttaccattaattctagccccaacagaatgtgcaccaacttctgagtgaatcatataggcaaaatctaaaggaactgagcctttaggaagttcataaacatcgcctttaggtgtaaaaacatataccctatctgagaagatatctgttttaacactcttcataaattcatgagaatctttggtctcattttggagctcaagaatttcttggaacatgttgagctttttatttgcatctgtttgctcaacttctcccttgacgccttctttatatgcccagtgagccgcgacaccgtattcagcaacttggtgcatagcctctgttctaatttggatttctagcggcttgcctccaggtccaataattgtagtatgaagagattgatagccatttacctttggaacggcaatatagtccttaaaacgacctggcattggcttccatttagtatgaactgcacctaaaacagcgtaacaatctttcacagatttaactattactcgaacagctaataagtcataaatctcgctaaagtctttgtgcttattaaccatttttttataaattgaataaatatgttttggacgaccataaatctcatacttaatgcctaagctatctaaagtttgcttcaaagtcgaaattgcatccgcaatatatccttcacgctcacttcgcttagactgcattaaattaacaatccgataatattgttgtgggttgagataatgtaaactcatatcttcaagttcccacttaatcgttccaatacctaaacgatcagcaagaggagcatagatatctaaagtttcgtctgcaattcttctttgtttatctgggcgcaaatggtctaaagtatgcatattatgtaaacggtcggctaatttaaccatgattacgcgtaaatctttagccatcgcaattaacatcttacggtgattatcagccaagtattcttcatggctcttagatttatattgaatcttacttaatttagtcacaccatcaacaataaatgcaacgtccttaccaaatttttctttgatatcatcgttagttacaggtgtatcttcaaccgtatcatgtaaatatccggccgctactgtatcaggatctaaacgtaaagttgccaatgttccagcaacttgagtgggatgaatgatataaggttgtccggaaactctgaattgaccctcatgtgctttcttagcaaattcatatgctgattcaacaaaagctaagtgttcatcattcatatatttcttacattcagcaagaacttcttcatgagtcatttcatgatattttgacataacgtatcacctattctttatttcttttctttgtaaaaatcatcatgccataaaccaaataattcaaaacttaaatatactaagcacaataagaagttatatttagcaaagtgaatgaaaactgcaatagcaaaaactacaggaaaaagaagtagccaccaacagcttaactttctaatttgcataatacgaccaatttggtagcttaaataagtattaaaaataaagaaaactagtccaattcgccaaactcgacttagatgaacgagtggacagataatccaaacaattactcctaataaagttaaccaaataagaggcataaatgatttttcatttattttactccatgaagccttaaaattaaaatttttcttttcttcactatttttcttcatttttcgcttaccttttcttttaattaatatttttaatttggttttctagcaattaatagtccaatccagcggccttcttgcattttcattttaattacaaaattattctcttctagcgccttctctattttgggaagttgtaaataatcaattcctgaaaaaataattttaccattttcattcaaatgattatctagatccggaattaattctaacagaatatcagctaaaatatttgccacgattagatcatatttttcatcaatatcttttaacaaattagccttacgcacatcaatattatcaatattatttaaggcaatattttctttagcggcagtaacagcttcatcagagatgtcagttcctaatacatggcttgctcctaacttacttgcagcaattgccaaaataccagagcctgtaccaacatctaaaacagacatcggcttaactaaagcacgttccatagcaagcaaaactaactgtgttgtcgtatgcccaccagtaccaaaggcaagtcctggatctaaacgaatcagttgttgatcagagaaagctggttgatagtcttcccattcgggaacgatagctaaatgtcttgaaaagtcaatcacatgatagtatttttgccaagctgtattccaatcttcatcagccacttccttagtgctaattgaaacgttgccagcatctaagccataacccttcatttcagctattttatcagtaattttttgaattatcttctttttatcagcatttttatactcaaaatatgctgttaattctaaatcctcaggtaggttttcaatatcatctagttcaactaaactactatcatgtttttgaccctctaaaacaaagtcgctacgcttacgactttcaattccctgtgcatccagttcatcttgcatgaagaaacttaatccatcttctaattcataactacattcaacttttattgctaataatttcactaatcttgtcccccttttgacatgttaaattctcacgtttatgatattaaaaggtgagaaaaatgtcgaaaaaaaataaaaagaaaaaacttaataaaactttgattgagaagatgctcgaccaacaaaagattccatataaacaattacaattcgccacagttcaaaaaggcgatgttaaacaaatggatacttccattttagacgatgaagaggctttggtctacaaaaccttggtatgtgagggaaataaaaatagtcctgtagttggagttgttcctgttaccgagcacttaagtatgaaaaaacttgctaaagcttctggtaacaaaaaatgtgaattacttccacttaagaagttagtcgcaactactggttatgttcatggggccaacactccaattggaatttaccaaaagcatcattttcctatttatttagatagcagcatgaaagaacacgatcacattgctgtttcaagtggagaagtcggtagaagtatcatgatcaatcctgatgatttacaaaaagtcactaatgccactttcgttgatttattagagtaataagattaagtaaaaagcttctcatgactagaaaaataattctagttttgagaagcttttttagctactttttaacgatttttacccatctaaacacaccgtaaattattaatagtacccaactaaggattgaaatatagagtaaaattgtaaaccaaattggggtcttgaatgaaagaattgctgtattctttcctttcttttgcttgcactatcggcattccaatttcattacacttaggcgatacctttttaccatttactattagtactgattgtctgtagaaaacaattggtaaagtagaatctttcccatcactagtccaacttatctttaatttaccattacttgcagcttctttttcaaaaccctctccattattaaaaataagtgttccagaaacccagccacttaccttccaagaattcatttgcttttttagtggtagataatctggattgccaggaggattactatcaataaatttacttaaatcatggtatctaaattgattaacacgttcaacattagtttttactttattaaatttaataatatttcctcgtaaatctgctctcagagaaaataaacatacgaaaattagtaaacactctacaaatactttaaactgaaaatcataacgattgattagatttacgacggtaagccccatacttagaaatagtagcggataagctactgctgtaaatctattaggaaactggaagtagtttgaaaatgatggaaaatacttttctactactctccatgggaataaatctgaacttataaataaaaaagcaagtccctcaatagttaaaaatgtgtttaatttagatacacgataattaaatgcaacataaactgtttgtaaaccaaataagagtagaactgcttcctgaatttcagtccacattgttattgtgccgtttgatttaaggtgtaggactgttagcgccggtgaaaaatctaatggcgctgacattgtattttttggatatagtactaaaaatgcaccccatacatttgcagttaaaatcaaacatagaactaccgcttttaaagtatctacccacattctttttttgttttttgtagttaccaaaccataaacaaaaagtgggattaaagccaaaattgcctgtaaggtacttaataaatggacttgggcaacaattgccatcataattgcaagacttatccaattaaaatgttttttatcatcgttaaataaatttattccttgaattaaaacatagggcattaaggccgctccccatgcattaaaactatttgatgggatccaataacttatatatccgcaaagtaaaaacagcgtactcacaattaaagcaactgttcgtgataattttacttttctggcgagaatatacatcccaaaaccggcaactataaaaattaaataaacaagtataatctgataattaaaccacgagcccgcacttaataacaaacttcccattaaataagcaaagaatggaccataaattgcattaactatccgccctgtttctcccatcccataattcatttgaaaataagaaaaattatggttttttatttgctgagcagtatcgtaaaatctactgaaatgaaaaatagtatctgatcccgtaagagcaacatgattaaataattgcggaatttgtagtatagtcgctagcaatatacttaaaattagtggcaaaccatactcaattaatttttccttgtatttattcataaattatattttatcctccaagtaatattttcaatccaacttttcaattgtatcatttattgtttttcctttttacacttgttaacaaataatagagtcaattaatctataaaaataaaagcttcttaaaactaaaatcacattagttctaagaagcttttttagctattttttaattatttttacccatctgaatacaccataaattattaatagtgcccaactaaggatggaaatatacagtaaagcagtgaaccaagttggagtcttgaaggaaagaattgctgtatttttcccttttcttgactgaacttgtggcatccctatttcattcacttttggttttattactttactatttaaacttaactcagattgtttataaataaaaatcggaagtgtagttactttagaagttgagtctttccaagtaagctctaaacgcccatttgaaagagccctttgctcaaaattatttttttgtggagacatactcattaacataccagtaatatcacttgatttgatcttctttatgactggtaaataatcaggactattaatttccactttattgatatatggagctaatcccttttccttcatctccttagcattgctagtaattcctttgttgtaagtaatattattattaatctcattaaagtcggctctaacattgaatagcactactacaattgctaatgcactcgcaatcattccaagttttttaccatgactcttaattaattcattcagtgttaaaccaattccaagaaatagcaaaggatatgctacgacagtaaacctgttgggaaattgtaaataaccagttactgctggtagagtgtccttcacaaattgccatggaaacaaattagaacttaaatatagaaagactatcccttctaaggtaacaaaagtatttaatttagaagacttaaagttaaagattacataaattagttgaacaataaataggagcaatgtgacttcagtgattgacgtccacattgttgaagtaccagcaacagataaattaacagcggtcaaaactggtgagtaatcgatcggagatgccatttgattagttggatagagcagtaaaaatgcaccccatacgtttgctgttaacacaatgaataagccaacagctttaaagacatcaatccatatctgacgcttattttcactcaaaactaatccgtaaataaagaaaggaatcaaggcaagaatggagaaaaaagtgcttaacaaatggatctgagctacaattgccattacaattccaagactaatccagctaaagcgctttttatggttattcaataggttaattccttgaattaatacgaatggtattaaaactgcaccccaagaattgaaagcattagatctaggccaatatgcaatatagccagtagttagaaatagtgccgtaactattgaagaaacaacttgcgataatttaacctttctacttaaatgatagattcccagaccaccaaccaaaaaaattagataggttataagaatttggaaacgaagccaagaactacaaaataaaagtaaacatcccattaaataagcaaagaatgggccatataaagcattgactattcgcccactctcacccattccataattcatttgaaagtaagagaagttatgattctgtatttgctggtaagtatcataaaaacgatgaaagtgaaaagcagtgtcatccaaagtaagaccagatcgagtagtcaattcagtccaaattaaaacagttgcaattactagactcaaaattataggaataagataatctattattttatttttatatttttctacactatgatttttcatttcttacctctgataagtattgtctcaaccgtttaattgtatcattcaaccaggcgaaaaaaatacttatttaccacttttattcttcaggaactgacatatttaccatatttcttcccttgcgataggcttgtttgatatcatcaatagttaaatctttacccttttgatcatatgcaactaagacttctctaacaccatcagcaaacttacttaataatctaaatatagtaatttctgcaaagaataaaactaacaataagaaaacagcagttgcagagatacgtgaaagtgcaaataagttatggaagaaaataatagataaaactaatgctaaaaaggatccacctaaaacagtccacctaaatttatttagtggtctagaaatatggtatagcaccatcatccctactgcgactaataacatcgtagccgttgtagctacttctggtcttcctaattctaaaaccatatctgccactaccaaaattgagaccgcaagcatatccgtaattccaccaggaattgcccttgacagtacattaggaataaattttccgcgaatacggttgtaattattttcaagagctaataagaatgatggtagaccaatagtaaatgctgaaattaaggctatttgagccggacgcaatggataagacattgcaaaggcaagagaaaagatagccattaaaaatgaaaagatattctttaccaagaacaaactagctgatctttcaatgttattaactacttttctaccttcatctacaacttttggcattctagcaaaatcagaatctaataaaacaacttgggatgcttgaacagcagcactattgcctgatgccatagcaattgaacaatctgctgtcttcattgctaaaatgtcgttaacaccatctccggtcatggcaacagtattaccatttttttgaagagccttaattaactttttcttttgatcaggcttaacacgtccaaaaacattatattttttaacaacttcttcatagtcgccttcactgatttcggttgcatcaattaacttatctgcatcccgaataccggcctgctttgcaacgcgtgctaccgttaaagggttatctccagagatcaccttgatatttaccccttgacgatcaaaatattcaaaagtactttttgcttctttacggattggattagaaattaaaatatatcctaatagctcaacatgctctactaatttttccttttcatcccttagtgcatgcggatattttccaaaaactaaaacacgatatccttgtcgggtatattgatttatttctttttcataatttttaaattgatctcgcaatacaaattcaggcgcacccattaataaagtgttgttcttaataactgccccactatatttatttaccgaagtaaaagggatgatttgcgtagcctgaatattaaatttctgattaaatgcttttgcgacagctttgatagttgcattatcgtgaggcatattttgggcaaaaatagaaatttctttgctcaactcttctttagtaacactaactggaataacttcctctacttccattttaggttcagtaattgttccagtcttatcaacacatagcacattaacccgagctaatgtttcaacacttttcatatcatgaagcataacttgggaacgtgctaaacgcatagctgctaaggctaaagcaattgtagttaataaataaagaccctcaggaatcattccaataattgctgcttccattgagacaatactgtccgctagatttaaatgatttacataacgagcaacaatgaagagggcaattccacaggggatgatgatgattccaacccatttaatcaatcgattaattgagcgcaccatttcagagccctcttttgaattcatcgctttagcttctaaagttagcttagaaacataagaatttttgccaaccttttcaaggcgggcatatgcctttcctgcaactacgaagcttccggacattaattctgaaccaacatctttctctatttcatcagcttcaccagttagcaatgcttcatttactcgtaaagttccagaaataacttgcccatcagcaggaatttgatctcctgttttaagtacaattacatcccctaaaaccagatcttcgattggcacaattttttcttctttatcacgaattacggctatttttgttgtattcataacatttaacttgtctaaaacactttttgcacgtaattcttggacaatcccaattatcatatttgcgataataactggtaaaaatgttaaatccttgtattctccaacgatcactaacaagatcgctaatattaaaaatatcaagttaaaatacgtaaatgtattttctttaattatttgccaggtagtcttagcttgatcattaacagctcggttaacttttccctctttaattctttgctcaacttctgcttgtgttaagccaattggttgtttaaagttttccttcatttgcatccttaaaaaattaatctatctgtaaattatcgtctttttcaatcgttacctcaccagctacatcagtattaaaaaaatcagaaatctggtgaacatcccagttttggcctaatccccacatcagtttagtaatcgcactctctgaagtcatatcacgagcactaattgctccttcaagcagcgcttctctcccaacttcatattttgtaagatcacttcgctcatataagcattgactcgtcgcaataatcggtattcctcttctaatcaactttccaattgcagctaccatatttctgcggatgtaattcatcccgcctaaaccatacgcttcaattacaattccttgacatccgctttcgaccattgcaaatagcaaattaggatcaaaacccgggaatagtttaactaaagaaacatgaggattaatgctagtgtttaaagttgtatctttcatatcttttgtatttttaggtacattttggtcagaaaatactaggccatcagatgttacccgagccactggtggtacattaacactttcaaaagcatcaaaattgatcgttcttactttaacacttctgcaccccagcataacttttcgatcaaaggctaaataaatattaggatgacaactagcagctgccgcaaaagctaattttaaattatccggtgcatcactcaatacaacattaattggaacctggcttccagttagaacaaccggaatattaatattttgtaacataaaagaaagcatggatgctgtataggccatggtatcagtaccatgagatactacaatcccatcatacttatttcgattttcataaattttttcagcaatcaatttccattcttcaggctgaatattagatgaatcaagttggagaatatcttcgacagtaatatcataaggtaattcccctaacatattaattaactgctcaccagattctttaggcactaacccagcttctgaaacaactgacgcaattgttccacccgttgaaagcaataatattttcttttgcatttttcactcactctttaattctcttgttctattaattatacgaaaaaagttgtcatagtttaaattccatgacaactttttaataaaaatctatccggcatgccgccagtctttatccattaaaatccgagctgcaattaagcctaatggtaaacaaattacaatcattaaagcttgaaccatccataaggcgcctgcatttaatgacgttaatcctaagttaaacatagctcggtacatatatagtcccggcaccataattacaattgatggcaccgtaatagcaattcttgggaaaccagttttacgtctaataattgaagctaacattcctgcaacaaaggctccaataaaagcagccacagctggtggaacatttgaccaatcaactaaactcaagcgtaaagtatttgctatagctccggaaatccctgcaacagttgccattggaattctagaattaaacataattgagaagccaaaaactccgcagaaactagcaactaatcttaaaatagttaaaactaatggtgttagtcctaatttctcaaagttttgcggatgcaggtttaagatcaaagccattacccaaccaactgcagttgcaacaacaataatcatgattgcataagccattctctctaagcctgatctcatatcaagcttagaaatatctagtccagacgtaataaatggaaaacccggaattacaaagagcattgctccaatatatccatccaaatgtcgcagacggactggataaaataatctaattaagtaaaaactccctacatataccgcacaagctacggcaactgcaacggtaatattcgctaaaatagttagatgacgatcaatcatttttcggcgaacgtaatttccgcaccctgcacctaaaaatgcacaaataacttcaaaaattcctccgcctagtaaaaaaataaatcctgcacatgcaagaccagaagctaaaccaacttgccatggagaatattgcgatttcattgtcgaaatttcttctaatcgattatgaatttggccaattgtccaatttccgttatcttttttaaactgactgacgaaattttccatacggtctaatttagttgtattaactcctgtggatggtaaacttagcgcctgcgtataactcttaccatctgcatcaacacaagtatattcaattgaaacaagtccaatatccgtgctgcatgtcatatctaaacagcgagcaattgtattcatcgctgatcttacacgccacgctccggtcccacaagagagaagcatcatcccaatatgccctacaattaccgatcgttcagccaaagtcgcatttttagcaggtgtaatattatcactagtaaaaaactcctgccaccgaattcgcatatgatgatgatgcgacaaagtatgttgatgatggagctgatttacacgttcatttttactttctttactattcactttcatagtccccaaactttgattaaatatcatacctttaaaattttatcacacaaaaagcgtcttgcactctcaacttaagtacaagacgcttttaattattaaaattattgtttaaaggtcaattccgtcaacaacttccttcatcttagctgctgaataagccattttcttattttcatcttctgataagtgaagctcaatcacgtcactaattccattagcagtaactacagctgggcttcctatgtaaagatcatgaataccatattctccagtcattggcgcagatagtggcatcactagagccttattttctaagattgccttacagatttgtgttaagcacattgcaacgccataaaaagttgctcccttattagcaatgatcttaccaccctttttacgaacatcagtctctaattcaaccaatgtttcttcatctaattctttataagaacgaagaggcttatgatcaataattgcttcatcaaaattttcaaaagatgtatcaccatgttcacctaaaacataagcatcaatatgatcaacattaacaccagtcttatgtgataaagccacacgcaagcgagctgtatcaagggatgtaccggttccgataactttattcttaggaaaaccagataacttttgagttaaagtagttagaatatctactggattagcagaaacgacaaaaataccgttaaaaccagattctacaattggttttatgattgattctaaaattttaacattagtttttaccaaatctagtctagtcattccaggttttcttgcggctccggcagtaattacagcaatatcggcatcttttgcatcactataatctccactcttaacagtgcattgaccaacaaatggggctaaatcttctaaatctaaagcatccccttcagtaatttttttgactacatcacaaattaccaattcatcaattctaacattttgcaataagtcatttgcaaaagttgaaccaacacggccgtcaccaactaaaaatacttttctacgactcatttttatatatactcctttaaatgaaagcttaagttctacactttaagtatacacaaatagcctttctattgaaagcgctttatttaattaaatctgccattgcttttccagcttcacgaccaaaaataattgtttcagcaatcgaattaccaccaattcgattgttaccgtgtaagccaccactaacttcacccgcagcatataaaccagaaataaagtttccgttagtatcatagacacgggtatcaggtgcaacatgaattccgcccattgtgtaatgaatagcaggtgcaatatgaattgcataatatggtgcatggtctaactcagccattccggtagttcgaccaaattttgtatcatcattatttgctactgctttattccaattttcaagtgtttcttcaaggttggaaatgggcactttaatgttttcagctaattcttcaatagtgtttccatgaacaactaaattaattgaatcataaaattcaattgccttaaccctatctctaactccttggtcaaagatcaaatatgcagaatgttctggagtttgggtaatcgcatttgatacgatctttcgcgtattcaattcattaacaaatctcttaccttgatgatcaactaaaatagctccttcaccgcgtactgcttcaccaattaaatacgcatgatctgtatcttgttgaactgtagggtgaacttgaactaactctaattgctcaagttgtgctcccactttattagctaattttaagccgtctccagtcgcaccaggttgattagttgtcttatagttacgcaaatctggtcgatacttagcgattaaatctttagaagcaccaaaaccaccagtagcaagtaaaactgctttagcttttacttgccgatcattattaacttctactccattaattttcttgttgtcatcttgtaataatttagtcaccttagcatcagtaaaaattggaatattcttttcatcagcaattttaagtaaattattaactaaaaatgcgccaattggtgccattgaagatggacggtgtgtacgttttttggacataccacctgtaattgttaaatcatctactttaattcctaagtcttcaagccacgcaatagccaaaggtgcatgctcgacaaaataatgtagcatttcacggtcattcatgtagccgccaccttttagcgtctcatcataaaatttttgcatactatcgtttacacctaaacgagcttgaacaatactttcagcagcattcataccagaactagctctcatagtgtttccacctaaaaagccattcttttctaaaattacaacattcaaaccatattgctgtgcttgaatagctgcggctaatcctgtaccaccgcttccgacaataattgcatcatattttttttgtaacttatctactgtttgtgttggaaatttatatcccattcttattccttcttctaatcatcaattggcttagtattcattgcattagtcatggtaattggtttcatccacttatcatattgttctttagtaactaagccgctctttaaagccgctgtacgcaaagtcgtattatttttagctgcagtctgtgcaatagtagcagcttcatggtaaccaatatgtggtgaaagtgcagtaactgtcattaatgaatttgctacatccttagccattctttctttattaacagtcataccatgaatcatcttatctgcaaagccagaaatagttccagataaaacattggcagactctaaaaatgctgcaatcatcactggcttaaagacattcatttcaaagtttccttgagatgcagccatagtaatagttgtatcatttccaaagactctcaaacatgccatggtaacagcttctgcttgagtcggatttactttacctggcataattgatgaaccaggttcgtttgcaggtaaattaagttctcctaaaccagctcttgggccagatcctaagaaacgaatatcttgagcaattttgaacatatcagctgccaaagcttttaaagcgccatgcacaacatttaagcctgagtgatttgctaaaccaaagaatttatttgtatcaactttaaaattatgtccatactttcttgataaacgctcagcgatatcttctgccataccaggagctgcattaagtccagtgccaaccgcagttcctccaattggtaattcataaagtgtttcttctaactcgttaatgtaggataaatcatgattaagagcagaaatatagcctgatagttcctgaccaaaagtcaatggaaccgcatcttgcaagtgggttcttcctactttaaccgttgtccaatactcatcttgtttcacttttagttctttaatcaagtgtttaatagaaggttttaagtcatctaacgcttgtgttgcaactaaattcattgcagttggaaaagtatcatttgatgattgtcccatgttcacatcatcattaggtaaaatatctaaaccgggatgatttttattagcaagattagccaccacttcattaacattcatattagtttgggtacctgatccagtttgatagacatgcaatggaaaatatggttgcaattcttcattgtttaaatcaagtagttgatgaattgcttcaataatggcacgtcctttttcttctgtttcagttcctgcttcaatattagcttgagcagcagctagctttatttgaagaagcgcacgaataataccaattggcattaacgctccagtatggaaattatccttacttctttgtgtttgtggaccccacaatgcctttttaggaatttctactgggcctaatgtatcactttcaacacgataaccttttttcaccatatttttgtcctccgttttcattatcttcattataagctacatttaaatgaaagggcatacaaaaagcggagaatataattcttcgctaatataattgtattaaattatactaaaaatactttttcaatgctatacgcttatcgttcttgatgattcaacttcttagcaactaggtctccaacaacttgaacaatcaataccaataataaaactaataaagttgctaccaaagtcacatcattattaaatctattgtatccatatgaaatggctgtattacctaagccaccagcaccaacagctcctgccattgcagttaacccaattaaactaatcaaagttacggttgaaactcgagctaattcagagcgactttctcttaaatatacgtcaaaaataatatctttggttgaagcacctaatgcttctgcagcttcaatctttcctttatctacactttcaagtgcaacttgaacttgtctagcaaaaaatgggaacacacctaaagttaatggtactaaagctgctttcatcccaatttgagttccaacaattttttgggtgactggagcaacaaaggctagcaaaataataaatggtacagctctaaaaatcgatacgattttatcaacaatccaataaactactttattagctaaaattccttttggttttgttaaaactaataataagccaaaaattaagcctagaattcccccaaaaacagctgaccaaaaagtcataaataaggtttggaaaatagctgttccccaaccagcatctccgccccaacctagggctactacattaggaaagtttttagtgaaaaaactaatcattagtcagcactcctttatctaacttcgttacaacaacatttttactctccaagaatttaatagcttctttttgctttaattcatttaaatttaataaaattgcaagtgttcctattggttcaccacttagaacttctacatttccatataaaatacttgcttttgtattcagcgaaacatctaaatcagccacaactgatttagttacatcattgatgctataaactaattgatacaattctgcgttctcggctaatttatcaaagttataagtattcaaaatatgttgagcctgcaaagccccacccacaaattgacgcgtaagttgcttttgaggatgtaagaagacctctctcaactcacctttttcgattacttttcccttttccattactacaattttatttgctacacgttttacagcatccatttcatgggtaattaaaacaacagttaggcctaattttttatttagatcatataataaatctaagatttgattagtagtttttggatcaagggcactcgttgcctcatcagaaatcaaaatatcaggatcattggccagggcacgggcaatagcaacacgctgttgctggcctccagataactgagccggataaaaatctgctttatcctttaagccaactaattctagtaaatggagagattttttctctaattcctggtcagataaacgactatgctgcaatgcaaaagcaacattttcaataacagtttcttcattcaataggttgaaattttgaaaaatcatcccaattttccgtcttttttcttgaagttgcttcttgcttatttgtaatttattgtctttaaacaacaccgttccattaacctctactgatccagcagaaggatattgaagtaagttgattgttcttactaaagtggattttccggctccagaaaatccaattacaccgtaaatatcacccttatttatttctaaacttacatcgttaactgctttattttgtccaaattgaacggtaatatttttcaaatcaatttgtgctgccattagactgctccccctcttactttaatttcaatccccaagctgcaacttcagtcttgccataaagcttgtcagataatttcttagttttttcagtttgatatgccttaactaaatccttgtaaattttgttattcctatcttttttatttgcaacaattatgttaatccattgttcagaatctttattcaaaggctcaatataaattgtttgcttatcgcctaatttagcaggaacggcataagtattattaacaatacttgcatctacatcatcaattactcttgctgtttgttctgcactaacttccttaatttttagtcccttaggatttgaagtaatatcagctaccgttgcaagtttaacgccctttttcaagttaattagtccagcatttttcaagacatataaagctcttgattcattagacgcatcatttggcactgcaattgtagcaccttgtggcaaatccttaatgctcttatatttctttgaatacaacctgattggagcaatataagtattcccaattgcgactagtgaaccatgatttgccttattccatgcatttaaaaatgtatagtgctggaaagcatttagatcaatatcaccattttgaagtgccttatttggttgattatagtcagtaaaattcttaattttaatttttatgccatactcttcttcagcagtttctgctacacttttccaaatttcagcgtcttgctttgtttgaccaactacacccactactacttctttttgattcttggcagtgttactggttggaccaaaactaaaccatccagcaattacaattaaaactgccactagtgaccaaattattctatttctaattctctttttatgcattgtactttcctccaaacaaaaaagcactcatccataaaaggacgagtgctcgcgttaccacctttaatttgccatttactcacataaatgaccttagtaagtagctcctaattttcattaagaattaccttgcgtttttaacgatcgcaactccgttgataacttattattaaaattcgttaccaccattttaatctctagtccatcttcaattagctgttttatctacttccaccacacgtagactctctaaaaaaacattaccaatttactcaactagcaaaatgtttaagttaattgttaaaaatatattataatcttaatcaaatttcgtcaagtctttttttaattttttattttcttatcgaaatcattatattattctgatacatgaggatatttaagaatggagaaagaatgatgaaaaataatattgtcaaaataataatgtggatcctcttttggttttatctaattccatattatttactaaaaaaatttgtttttaagaaaaacaaacatcaagttttttgggcaaattgtgtaacaatcgctttattagttttactaagtctagcgctcagcccaagcagtacaaccactacttcaattaatgagaacgcctcagccaaaagcagcagagtagttcataaaacggtcattaaaaaagttggaactaaagaacttaataaagaaaaagctagagctaaggttctcaaacaagaacaaaagaataaacaagctgaatatgacaagttaaagcagcaacttgatgactaccaagaaaaagaagaacaacaaaaacaagaagctgaacaagcaagaaaaaaggttgaagcggcagctaaaaaagaggccaaagcccgtcaaaaagaagctgaagaacaacaaaaagctgctcaacgtcaggaagcaaatactagtagttcttctaattcttctgattcttctaatcaaggtgatctttatactggtaaccaaggaacaattgtcggaaacagtaattcaaaaatctaccatgtacctggtcaagcaggctaccatatgaattcagctaatgccgtttactttaacagtgaacaagacgcaattaatgctggttatagaaaggccaaaagataatgaaacataagaaaattaccgaatttttaacagttacccttttgttttctctcggacttagtcaaacatatactgttcaagctagttcatctaacgatactaaagtcgctaaaaaatataagtatgactatactgatcaaaagaaagcaaaaaatttaaaaaagaagaacaaaaaaattgagaagaaaattaactctttggataaaaagatagctgatcttcaaaagcaattaaaaaactacactaatccaaatgcagttgaatctttaagtaaacaaaaattagctagtcttgattatacggggaaaactgttgttaatgtgaacaataataatccagatttttcaaagcaagatttagatacgaatcatggcgcctggcaaaaatatggcgatcttgattcacaaaatcgcgtaactgcagcaaatgcacttttaaatagttccttaatgccaaaaacaaaacgagagccactacatgtcaatccaactggctggcataataagaaaataaatgaccattggctctataatcgttctcatttaattggttatcaactcacaggtcaaaataataattggaaaaatttaatgactgggactagacacttaaatgaccccgatatgttaatgtatgaaaacgaggtggccacttatctaaaagcctccccatcaaattatgttcgttatcgtgttacgcccatttttagaaataatgagttattagctcgtggtgtcgaaatggaaggtcagtcaattaattcaaatgacgttcatttccatgtttatatatttaatgttcaagatggcgtaaacttaaattactcaaatggaaccaataaagcttcttaagttttaataaaataactatattaaagttatttttttgatatacttctattcgcttctcttaatttcctaagttcaaacctatacttttctttcataatacttattcaattagtatttatgcttaatggtttaggtgtatgaatatactaaatgaagaaagataatattataaattcttcatttaattacagtttaactttattctaaaaagcgcaggcagaaatctgtgtgaaaggaattgtgattgaagtgatagacaacttaggagctgcgatcaaaaaaaggcgcaggagtttgagaatgactcaagaagaccttgcggaattcagtagtctatcagtgaatttcatctctaagattgaaagaacaggtaatcaaaatatcagtattcaaaaattagatgcgattgcaaaggcactacaaacatccgtaattactttaattgatgaatcatccaaaactcctgaaccacaggcatttgcaagtaagttaagcaatgaccgtgtttttcttgacaagcttacaaatgacatgaaaaaacttcctgttgaacaggaagaagctttagctaaaagttttattactataattaatacttttgctaaagaagataaataaaaactttgccagatatcttctatctggcaaagtttttttattttatagtctaattttgataattaattgtttgcttttcaatcaacttgtaatctgttaactcatcaccatttaagttttctttatttaattcaatggcgttaatttgattattttcataattggtataataaaacgtgcctgtctccaagttagttccatcagagtaaattgtgtactcataagaatttggtccgacttcatctgttccctttggctgttcaaccgaatgtaaaatatggaaataatttgttacactacttaattcattatttccttgaggggaatgtgcccgaacaaaagctattttcacaaaacgactggccgaatccattcctcctggcaaaaaatgagtccctaacccgcgactatataaattaaggtcaacacctggaacaagagtatttttaggctgtgcaggtgctatattactataattagctaagttacgtaactggcctggaaattcaggattattggttaaaacatgaactggattatcataaacgtgtaatccacttaaagtcgattctacaacgatcgactcaccagtcttatcagccattaaccagtgaagtggagaaagtggtagtttttctgaaaagtttatatttactaagctaacatctttcaatgcatcttttacttcagcaaccgtagtacattgacttagcaaataaggaattaattcaaatggtgtaacattatttttctccgcattttctggaaaataatgacacggaccatcaaaattaaggccagcaattcctagcccttcttcatttgctgcatcaaaatatagtggataattattttctacaatcgccatcccaaccatggcatattttgcctttttacttggtaatttacgatattgaaactcataattccttggtgtaattacaggatgttcaccaaaagaaatttccaagtctagatttcggccaaaataatgatgattatttgaactataaacaattgaggtacacatataaactcctccttatatcttttacagtccctatattactctttttttcaaaaataaaaaggaaacttctcctatgaagtttccttattttattattagtatatttttcgaacgtgatcttgaatagttgggttatctaaaaattcatcatagctagtatctgcacgactaacaattcctttagggccgacctcaataatatgatctgcgatagtttgaataaattcatgatcgtgagatgtaaataagattgaaccttggtagtccttcaaagcatcgttaagagaagtaattgattctaaatccaaatggttagtaggatcatccattaccaaaacattagctggttcaagcatcattcttgaaagctggcagcgaaccttttctcccccagaaagcaccttaatcttcttgtcgatctcttcaccagaaaagagcattcgacctaaaaagccacgtaaaaaagtattatcatcttgttccttagtagcatattggcgaagccaatctaaaatcgttaattcatcattgttaaagttcgcattcaaatcacgtgacatatagttataggcagtagtttgaccccaagttacggtaccactttctggcttaattttaccagcaataatatccatcaaagcagtggttgccaaagtattacgtgataaaaatgcaactttatcaccaggacgcactataaatgaaacatggtctaaaatcttttcaccatcaacactataagatacatcttctacttttagtaaatcgttccctaggtcacggtgcatttcaaattttacataaggatatttacgagaagatggtctaatatcatcaagggtaattttttctaattgtttctttctcgaagtggcttgttttgatttagacgcatttgctgagaaacgagcaataaattcttgaagttcttttattttttcttcttttttagcattttggttagctgctaattcacttgcaagcttacttgattcataccagaaatcgtaattacccatgtataattgaattttgccataatcaacatcacacatttgtgtacatacttgatttaagaagtgacgggtcgtgggaaactacaataacaatatttggataatcggctaaaaagtcttcaagccagtttacagtatgaacatctaaaccgttagtgggctcatcaattaaaagaatatcaggattaccaaataaggcttgtgctaataatactttaactttttccgcttctggtaattcactcatcttactttgatgcaactcttctggtatacctaaagactgcaaaagcttagatgcgtctgcttcggcgttccaaccgtcaagttcagcaaatttagattctaattctgcagccttaactccatcttcatcgctaaaatcagccttagaataaagctcatccttatctttcattacttgataaagttctttatgcccctgaattactgtatctaaaacagtaaattcttcgaaagcaaagtgatcttgattcaagctcgacattctttcattagcatcaatagaaatattaccagtagtaggttcaatcttaccttctaacagtttcaaaaaagttgacttaccggcaccattagcaccgattactccataacaattaccgggagtgaatttcaagttaacatcttcgtataaggtacgaccagataaatttaaacttaaatctgagacagtaatcaaattattttcctctcttacatctaattttttagttataacacattatagaaagtctttttatgaaaatttaatgcaaactggtaatgaatgtagctaatccaaataaaatccccggaaagttagctacaaacaacggccaatcctttttctctcttaagagagcatacagaacccaaataaggcagttaatggctgcgactaatggctgaataggattgccgtaatttccttgcaaattattcataatttgtggaatataagaaacatacattagaacagataaaactgagccaattcgtccaatcgttaatacagtcttattatcaaaagatctaattttctttttcaactaatcttcctttctatactatgttatctagtttacttactttttatagttatctcaagcacaaaaaaagagattgatcaaaaatcaatctctttttttaatatcaacttatattaatctaagtcaacgttgtctgggaagaatgctaaacgttcacccttaccaagttcttcttcgatttcaagtaaacggttgtacttttcaacacgttctgaacgagctggagcaccagtcttcaattgaccaccgttaacagcaactgcgaagtcagcgatgaaagtatcaccagtttcacctgaacggtgagaaatcatagtgttgtaaccattcttacgtgaaagacgaatagtttcaagagtttcagtaacagtaccgatttggttcaacttgattaatgaagcgttaccagcaccttcgtgaatagccttgttcaaaagcttagggttagtacaaatgaagtcgtcaagaacgatttggatacggtccttgtggctttgagtaaacttaaccataccttcaacatcgttttcatcgtatgggtcttccatagaaattaattctgggaattcgtcaagtaacttgtcgtagtagtctgccaattcttcgtcagtaagaactttaccttcaaggtggtacttgccgtcttctttgttgtagaagtatgaagcagcacagtcacatgcaatagcaatatcttcacctggcttgtaaccagccttgatgattgattcatgtaatgccttcaaagcttcttctgagttcttcatgttaggagcgaaaccaccttcgtcacctaagccagtttcgtaacccatatcttcaagaactttcttcaaagtgtggtatacgttaacaatcttttcaaaaccatcacggaatgaagtcttagcaactggggtaatcatgaattcttgaatatcgataccgttgtctgcgtgttcaccaccgttaataacgttgtggaaagtttgaggcatttcaaggtcagtaccaccaaggtaacggtataatggttggtggttatccttagcagctgcagcagcagtagccatagatacacctaagatagcgttagcaccaagacggcccttgtttggagtaccatctaaagcaatcatagttgcgtcgatgtttggttgatcatgtggatctaatccctttaaagcgtcgttgatttcagtgttaacgttgttaacagcgttcataacacctttaccaccaagacgtgaaccaccatcacgtaattcaacagcttcgttttcaccagttgaagcaccagatggaacttcagccttacctacaacaccgtttgaaagagtaacgaaaacttcaacagttgggttaccacgtgaatcaaagatttcaagtgcatgtacattctcaataactgatttgagcattaaaaaaatcctccttaaatttgtggcgaaaaatacaaactaaccgaattggcatctagtcagtgtttttcgtcgcttttaggcatagcccttttgactacagatttattttaaagcaactttgtgagtatgtaaactaaagaaagcaattatttttttataaaaaaagatcgaccattaaaaggccaatcctaaaagttgctgtgcaattgtaaaacaaaatagggctaaagttgttgctcctaaaacatcagatggatagtgtgcacgcatatttaaacgtgacactactaccagtccccatacgattatcaaagtaattaagagccagattcccataatatgaccaaagatttgccataacattaatgacataatagttgcgcttaatacatgtccactaggaaagctatagccatctcgataggttctcattgacaagggtctttttcttttaactgaatgcttcaaaaagattccaactgcatcagttactgctaaagtacctaaagaccaaagagcaagccaagggtgatgaaacaaaactaaaagtcctgctaataaaaagtcccaaacaacaattaccttaggctcatttaagactgtaataactttccaaattttaccgtctctatttttaacaagtttatggtgcaataaatgatcataaaaattaaatagacgagaatttctaatgttaaatattaatcctaaaagaatcaatgccgaaatcagcaattgaattaaacaatgcaatttcacttttacttaacctcaattaattgtgctaataaatattgtaacagcaaaaaaataaagcacatacgtttttaaattttatttaactatttcaataaaaaataagaataagatttcatcccgagcaaatatttagcgatcaaagtgtataaaaaagcccgtaagattactacttacggaccaaatttaaaggagagtacaggtttcagtgtttgattacttatgtttacataacacacttgaaacattgatttatcagtattcattgctttataactttataattcagtgattctttttagccatttttagccaaaaaataagccgttctcctgtagtccaccctcaacgcttagaaggttgcactaagcgattaaaaaagcattaccttttgtgacgatcaggtagtgctttttgagtgcattgaattcaaacttccttacttagttgcaaataaattataacattttgcaagtaaatttgtaataaaaaaacatagttaaaataataggaaatttattgtatgcaaaaaagccactccagagaattaactccagagtggcttttaaaatgcattttaattcgtttcttaaattgacaatagacatagaaacttcaaagatatctatccaaaggactaaatccccagtaattaaattatatcactttatattacttaaaagttccccaagcatcgttgcctacacgaccaactaaataaccatagtgattacttccacgcggttgttgtagccaaactctgcctgcactatctctagcccaagcgttgtatttaactactgaccctgctggcaatgtggtaattaacatgctttccgtgctagcaccccagcgtaagttaattgcgccaccagtaatgaatgtgccgtgttcttcatgccaagtcataccttgtacatcagtccaagtcgtaccagttgggttagcaggagttgggtttgatggttgtggtttaagagatggtgcatcagacttaagatcaattaaagtgatattagcatcaacatctaagtcgtaccaattgctactaaattgccaaattgcaatattatccattgatggaaaataaccaaaatctgctgtatcttgacgattcatagtcttatatgatgcaacccataaacaagtcccatacttagcagtgatcttcttaacatttatgttattagttaataaggattttccagaatataacagtggcttatatcctgctgcaacaatcacatcaagaaaagctaatacagcattagcactagcttcatagccttgattagttacattaccactaccagtttcccagtcgcaagttaggtatgaaccctttggcaatccaactgctacagcagagttaacggcataatgaccttcttgtactgctacgccaccattggcgctaaaacgtgcatagtgatatccactaaccatcattccattatctttagcactattaatttgagcctctgctttaggattgcgataatctagtccttcagatactttcacaaacgcatatttagcaccaagattagcatatttagctaaatctgttccttgaaaacttgaaacatcaacgccataacttctttttgctacttgcatctacttacctcctacttctttacttctcttaattctccaaccacagtaggtttaggcttatctactgtatctgcaattgattgtgcttgcttcatagcagtgaccgacttttcaaccatacctttgacaaagctcatagttgggtgtggcaagtgtgccatatctaagagcagaaacaagccttgaacgacaaaagttagcttatcttctccgtcccctcccctcttttctgcttggtagacaaggggacttacagactgggcaacaatcttttcagccttagccaaaagatcaccttgtgctgctttcttgtcgattgcaattttgtgtttagcatacacagaagcaacaacgactgctgcaactgatacgactacgatggatagatctaataattggttgacactcattattttgcctcctttaaatctttaatacgtaacttcaaagccttggcatacttacccattgcttgcttttgctcgattagtaaagcacgttggttaacagataaagttttcttgttttgttttgacaaaaattttgacaacttaccgcgctttgcatttagcttatttaactctttttctagttttttaatcacgttttttactctttccatcaaaaaaggcaccattagttggtgtcttctttacatattcatctactaaaatctgttgttgatcaaccttacgttgcaatttcagatttttttcttttagtctatctatctctttctcttgttcttggcatttttcttggtagtggtcacgctcttctttgagagcatcgaatacccacttccaaaccgcaatcaagaacgtacctataccaccaagataaggcagtgcccttagtaaatcgcctataaagcaccacccctatctaataattatgcttcttacttttgctaatgatagaaaaatcaaaaagtaaaataataacttctagaaaaccggctgtaaacatatgtggatgtccggatatataaccgtggcagaattcagcaattgcttcaaatgctaacaagcctgcagtaataattaataaattgcgattagtagaaatactatttttattgctgattgcccaactaaaaagccaaacaccaatagcaatgaagataccacctactaagtcgtcatttaagacctcaaccgcaaaaggtggccagaaaaagtagaagtcattgcagataagaattagccctatacccatcattgcaaaagccagtatttcatgttgtgggtgttcagaatgtaggagcttttttagcttaagtttcatcttacaccttctcatttataaatttgccaattctgtctgctaaaagaatgtgtccagctctagttggatgtagagaatctgtcatgtacttatctttgaaatctttgttgaatgggtaaaacattgaggagtatagatctagaacaggaacagcatacttagatgcacttttcttaattgcatctacataatctttgagatacaatccttccacattttttccgcttgtatcatctacaccattggctggtctagtagtccaatctgtttgtaatggtgtgacgagtataatagttgctccaacatattgagatctcaaattagtcaaaagtgtatttaacgctccgtaaaaagtagtaatatctacactcttgtcgtcccctaattgtctcccgtatacccagtcattaactcctgcaaatatcacaatcacatctgcatcttgatccattcgagagtaagaacttattagcggctcaatattatcccattcaaatctatcaatagatttttgagatattgatgcacctgcaacaccatagttccttataagatctgctccagtaacagtctttaaatcacttacatatgattttgacgtattaattccttgactaatactatccccaagaacattaattttatgtccttttaatggttcaaaactattatatttaactccatctataaaaatagttggattaccatttagaacaatatgattaggataccaataagcaccaatatttccccaattaaaactgatattttcatctaagcttgatactattttttttacatcaaaatcatagtatagccatgctcctgattttattttttcaatattaataggattagaattaatttcttcggtagtgtgaccataagaaatgtataagttattaaagctcatagtattagctgcagtatctatttgtactgaacctaagccactaatcattggaattgtagtgcttggtgttatgttctcattagtaataacacctaaagttttaggattattatttatttttagttggagattggttttaatgttccacgaagatggctcgaatgaatcatacatcatacctacacttataagattactatcttcatttggtgcactaaatgtctgtaatttccaagttgcatcattgaaatagatccaagttcctctactatgacctagaccgactagagcaacttttttgttagaaataggcatcattctactgcgatatactacttggctttcctgtggtaggttcatataccactgttcatcatcgaaagtaatatttattgtcccttgaccaacaatcattccatctccaacttgcagagatacattttttgatggaatccaagttttaggaattacattattttgagggtaagcatcagctattttggatcctcgaacgatacaaaagtcccgttttttaaaagtatctgtatctcttaaagatacaggaattttaatcgcagtaatatcttgcggaattgttactgtgattaaagattcattggcatccccaccagatacataagtatcgtttttccaaaaagtgtaactgtaagttaattgattccaagtaatctgttcactcggactaaccccaatggatatttctccccagtcggagtttggaataaaagtcccatcagctttatgaaatccgcctagtctgatatttgatgataattccgagtataaattaggcgctttctcatcttggtatacgccttttaagttttcaatatctaccgtctctggagcaatgcctgcactttgataaattcctccatcttgccattggctgtcagtccagatagctctatgaccattagatgttacaactagttgttctgtcccattgggaaatttttcttttactgaatctaaattagcaagcatgatgggtgttgcagaaatttttgacaattgattttgaaccatatttttcatagattcattattttggttgaattcacctcgtttgatgatgtcgtttttgtcaatttgatcttgataattaatcaatcgatttccaataattctttcttcagctctaacttcttcaacctcggcattcttggcaattaaggcatcacgagtagcctgtgtctctttagtataagcatctctagcttctttgattacttgatctgttttgtcttcaatttgacggattagtttttcaactctatcactatagtacttctgagttaatccaaacatgacatcattgccaagtactctaaaccaaatgtcaattgaagttaatctgcgaccgttcccatccatcaagccaatttttccatagaaaatgcccttctgagtaaacatttgatcagtcagaatgtaatcagcccagccaccatctcgtgtattagcagcactaccttgccaatcacgataatcggcatcaggagccattacgatattgtcatcgtcgtcagtatgccactgaccaactgcaccctctataaaagggatcatgccatttacgttcatcacacgtccttggtcataccactgtactggcaaaattttgccattatcagccacacgcatcttaatgtagtcattaattgatgcacttgattgaccagccttagaaatatcggcttttaagaaatatggttctccatgattaacgcttgtcattgtcataatctatacttatcccctttgctttctttgcattattgatatcgttttgactatcaattgatatttcagtagccccatcgccaaagacggcaagattgagcttgtcaatctgtttattaatcgttccaatatctcgtttaacttctgccacttcattaggcaaaacttctaatgctgttactcgcttatccagattacttaaatcctgctcaagcttatccaccttttgagcttgtgtcatgcagtactcaagtccctgcgccatagcttcacggacatcaacgccaaactttttgtggcgtatagcgtccgcaatttgttgtggcgttaactgtttgccatctatgtggctgttgtcaaaataattagccatcactttctcccttctgttctaatttatccagcctttctccaaatgatttcagttgttcaactgtcgcatacttaattggtagttcttcatctaagaacttcttaaccttggcatagtctgttaagtgcttatctagctcatctttgattttttgagcattaaaatcgctctgttctgaaacatgttgaactttttgattagtctgattattgctactttcagcactcattgcaccagatgaaaggttagcaatggtcaaagattgctgggctaaagttttttgaatagattgaaaacgagcattaattttcttaccgtcctcaatttgatagtcagttaaactcttagcaacatcagcgatctttaagctactatttctttcgtgagcgaaatcaatatctttttcgactacttgaagtaattgggctgttttggatacctgagggttgatgaactgatatgaatctccaactctaaaccgatcaaattcaggcaattctaatgctgaaacttcaaatgagttcttagtgacgtgctgtttttcattagcaagccatttttcgcccatttgtttgatttgagctgggtcttgcaagtcatcaaaaatcttcgttccttcgatcacgccaaactgccgtattaagtcagcatcttcaatgtaatctttgccaccattaacactagtgatgttaaatctaggctgtgggctttcatcttcgtaagtagtcgaggtactatctttatcgcccttctgaccgccctctttaattaacttcaaaggatctagccaagcccagttagggtcaaaagaatgaccttttgtgtaaccctcataccaagattttttcgtaaccccgatatggacgtgactagtatcacgtattccaattacatcgccagtcttaattgtttgtccttgactaactttgatgtttccacgacttgagaaagcttcttgatagacaatatcatagccgtctcgtgagtgagtaactacataccaacctatgtagccgtcagaaccaatacgagttactgtaccaccatgaattgcatgtacttcacttccagggtggtcaatactaccgaaatcaagcccatcatgaaaattattggttcttccattacctgcatgaacgccaaaaagttgtgcctccatgaagtgaccttcgccaacgctaggaaacggccaaccccatgtattatgtgatgttttatgaactgtagtagtacttacttctttaaggcgtggattaccgttaggtgaccacgaatgatagatctgccacttatcaacttctgattgccagtcgtccatattgaataagcataagagctgatcgaacccagctttccaagtagtaaacggtttaacacaataatgcttaaaagtttcttcaatgaattgcaatagccccgcacttgggtgaccagcagctgcattactgtctattgtgttaacaacagtttcagatccaccactttcgccttgtatcatgcgcttaatcttttcaacataatcatcagttatgtttacgcccataagcttagcagcatatctaatagcaggtccccaatcgccattaacagcatgggttgttcctgaaataggaacaccatgttcatcgagtgtatcatcgtttcctaaattaatcttaggcgatggttgaaccttaccaagcgggattaatcgagtgattatcccagtagggtcaatggtctgcttagccgataacatattcttacctacagaaataggagtatcagccttatgcgatactcctattgtttttgtgtagtcaatataatttgtctgtttatcgtggtcatatctaactcgaatataaccaccgcttttattaattagctgggctgtaattgcttctttagtagtcggataatcaatctgcctttgaacaataccttcgctgtctgaataatcacagttaccaagtgtaaagtgcttataagtatcattcaactgctcattatgcaccttaattagtttctgtaagtactgcttagcacttgacccagaatcattatcaaagcgttgaatgctatctaaaagataagcatcaatagcttcaaaaacgtattcacgagtaaatccaccatttgaagccatctctttgattggtttaatcgctcgtccacgaaagataagcgcatcatcttcatagacttcaacgtgagtaattaacggctctacattgtcatagagaggattgttctgattaacagtgatatcaagatcatcaatatctgttaatttaagatttaaacttccagatactaagttccttgttggaaggctctggtcatacactatatagccattcttatctgtcggcttgtcatatgctataatccgatatcccactacatcatctcctctcgtttgaattggaagtggattgtgccattgcctgaaacagtaagattagtcactccaactggtagcattacactaaccttagttgctgcaacttgatctaaatcaagattgatatttgagcctgtaactttcacctttcctgttactgcaaagcctagttctatcggcttagagccgtaattatcaaggtcagccttaacagaattgccatttacttcaaaagaagtttgctggcattcccaattgtcaaaattgatctcatcccagatatcactaccttcatagctcctagcaattgcataaggatatgctttgaacttaaccgtggctgttagagtaccgttactttcatcatcagaacactcaatactttcagatttagcagaaaaacaaaatccaggattaaaagtatcatcaagctctctatatcctgctgcttgcatgattaggcgcttgatttccttttctttcgccttcctatatgaataatcatcgtcaactaaaagaagctcgtaagtgatctcacgggcttcaaaaaatctctgattatctaagttagaaaagtcttcctcgccttgcgaataaggaactgaataagtgatctctttttctttaggtgttggtgcatccctcttagtaagccaccagcctttatcagctgaattgaagttagcaaacgtaaagccttcatcaggagcacgaaccataaccggcgaggtttcgattgtgtcatgaaaaaggccatcattctcatattgcctattaaactgtgaaaaaattctatcttcacgcattattttgaaaacctttcatttaatgaaatatcactaccgaatttttgattatatacatcagcagttgatccaactaatgcaccagtatccattactatttgttgctttctatcaagcttgctgctaatatttgcaattaaaccaagcaactgattattaggattaatgctaagttgactacgagtatcaagaataaatccagcttcgccagctaatgtactacgaactcgtccaattaaattctgggcactcttttgcgcatcttctgtatattcgtcaataccagaagcaatacctttagcaagccattgaccaacttctaatttcattacccttgaaggtgaatgaatatcagcttttcttctagcagctgcaactgcattttgaactgcactttctgctgcttgtctaatagctcctgatccactagagataccatcagcaattccttctgccaaatattgaccagttgaatacatatcgctgtgataagatctagctccactattggctgaactgcctaaatcttttccggttgatctcattgcactggatttagattttagaccgctctgcatagaacttcctaatgttgttccagtacttttagctgaagactttttactgtttaagccactgattgcacttgatcctaatgaagcagcagcagaatgaactgaatccttgccacttttaattccagaagcataattacttgctactgatttaccagcagacttaactgaactagttgatgacttagcaccattagctgccgctttaggtaattccttcgaagcagaagaaacagaacccttaccagatttaacccctgaagagtatgcagtggctgtctttttaccttctgcttttgctttgcctgtattagcttttaatcctttatcggcagcatcagaaacttttttagcggatttttgaacattgggagcttgagagcttaatccattagagatttctttagctcgctttgttccttcatcgttggaaccttttccctttccgccacctttacgtttagataagcctttatcgactttatcactaatattttctccggcagcttcataatttcctcgcttaatagcatctaagaaactctgctttccgtcactaccacctttaaacatcttggctggtaatttacccaaatctttcataacttggttattcattaagttaccagctttttctaaatctccggaagctacagcatttaagaagttttgtgttccttgttttccagctgttccaaagtactgagccattacctgcatacgttcccacatcgtagctgaatgttgattaatttcactcaacatttcttctaagccttgagtggtactaattttcatcttatttaatgcttgtgtgaaagtcttatgagttagctgaccggaacgagccattgactcaacaatttgagtattgttattgtcaatctcttgcagttttttctgatcgctttgttttaaagcgtctaattgcatttgatagccattcttttcagtttcggttttggcactagctaacttttgttctaagtccttttcacgttgtgcattagcttcatgttctgaatacaaagcattattttgttgctttattgcagcgatctgtctggttgtatcttctttagtccacttttcatgattatcaatcttaagtctaaaagctcttaattccatattggattgatcaattaaagcttgtgcaactgcctcattttgatctttaagggcttgcttttgctcatcagttaatttctgaccattagaagcaactccagattgcagcattttattattgtcattcataatttgctgcatttgatcagcgcccttagattggtcgcttagcatctcattaatagcagcagctcgtaacttccgctgattttctccgctttcttttgttgcttgctccattaaggcactggatttcttttgaatctcttgctgtttagaactccatgattttaataaagtttcgctggttgaaacatatcctttcatcccatcatcagaaccaaaggctgacttcatcgattcgacgacttggtcaaaactttctttattagccttattatcattttgcatagatttagaggcttcagaccacgccttttgaaaatcttttgctttttctgcatcatcatctgtcgatttaccaacttgctttaaagcattaacagttttagcagtggcactattattagctaagttctgccattgcttaccaatatcagaaattccatctttaatagcacctactgatcctttagcactttcagcggcgcccttaaagtcgcctttaaagaactttccgatagcctctccaccttttgcaatagcggtaattaaagctttaattgcaataacaattgtggagatacctgtgattacagttctaatagtatcaatcgcaccagcgactaccaacataatcgctgataaagcaaccaataaagtaccaccaataactattgcaattccttgcaaaactggtttcagggcttctaatactacttttaaggcattgattatcggactaactgtactttgcatactagaaaagctttgactaacaccagaaacaaaactagaaacaactccacgaatattcataaagttgtttttccacattacagtaaaagccacaactgcagcagttattgcagcaagtacgattccaactggaccaagtgcagcagtaagcgatgcaccaaatgttcgtgcaacacccaaaaccctacctaacccgctagtaattgcagcaatagtattttgaaaaacggaaagcaacataggcccaattgatcttagagaagaaaatgaagctctaattccagttcccattgttttaaaaatagaaactattctagagacaacggttctagcaatcgtttgcattgaacttcctgcacttagaagactaggtcctatatttctaacttgtgcggtcgatttttcgacattcggacctaatttattgaattcttctttgacaagatttaaacgatttctcaaaggatttaatgaattacttaaagcatttattccgctaatagattcagtagatttagtactactttcttcaatcttagttaaaagatttgaaagctccctagcagttgtctgatcttgctttcccaataaagaaatagcatttcttgccttatttattgcagtagttgatgcattacttttagttcctaatttatcaataattgcaactgcctcgctaatagcattctttgccgtttcaccagcaggccccattgtcttgatattattagacaccgcaagtatacgagcgccaaaagtttgaaattgagtaccaatcccaaagaattgagttaaacgagctgtagcagtactgattccaccagctaaacctaagaaaggttgagcaatagtattagaaatatttattgcagttttaaatgctaaaaatgcagtagttgcacgtaatactattggaattaaagcggctactttagtgctattttgctgaataaagttagctaatcctactagagcctgtgttatctgctgaactattgctcgaaatgtatttaaagccgcggctttatcgttttgcgcatacagtaagccataggattgaaccacactctcaattgctgatttccatgctggaaaaatctgcataatagcatcacgtaaaatattaaaaatatttctaattgtggctactgatcttttaatttgattgcctaatgcatcaagattttctttaatttttgaagaactcttgttaatccaacctgcaagatctacaccagttgccttttttatcgtattatcaatatcttcaatgatatccgctaatccggccttgacacggttcttcatattggctactgctgtaccaatacccgcagtagcattcaatgctgcttcatgaaaaccagttgcaccttgatcgagctcaataaaacgatcatttaattgtttcattgaaatctgaccagattgtactttagaatacaaatcttgcattgaaccagatgcaataccgaatgatttagctactttttgcaaagcataaggcatagtttcttcaagggatctccatgacatcatatctacttttccggtagaaagcatttgagtatattggattaaaccacgacttgcgtcttcagcactagcccctgatgcaataaaggcatcattcaacgctaaagtggatttagcagctttatttacgttatttccgacagccggataaagtttttcagtagtagaggcaactgtgtctaatgccgtcggcaagccgtcaacaccttttttcagcatgttaattgctgaggtactctctttaattggtgaccccattattttcataattcttggaaaattttgtagggtatcaaaccgtgagatcgccccatctaaggagctagtcatttctcctattcccttagaaattaaagagaatactgctgtacctttggccatctcacctagactcgccgtaacttggtttgtatcttcagacattcctcggatacgtgatctcatttgagcaatagcactagatatattatccctagcactaaacgttgcagtaacaccataactatcagacatcagttacctcctttccgttttgctatttgtttcttagctaattggcgtgctctttctgctctttgttgcaattgaagatatttattaaccttcttttgagacttaccactaattgccgatttttgccgctctaaatcaattccaatttcttttaatgatctatatttgtaatatccatctttatcagtaatagttgttagttgctgaataaatggaatctgataaaaaagactctccgcttcaatatatgcatagcggtgagcctttagtctttgtttccattcagtcagagtcatatttcctatttcttcacgagtaaaagtaggataatactgcatcattgtaataatgatttcatcaaaagttattcttgatttgctagtttctccattggatttttgatcttgtcgaatgcttctgtaatcaatggattgatagtcttcatcatccgtttggtaagtggttctgtcttgaaaaaatcgattaatactttatatagatctccactattcttatcacgaataactgctttttcgatgtctttttctttgatgttgtagcgttttaatagcttagtcaaaacatcaattaaagtaaaagcatctcccagatttagaccagccacaatattacttaaaatttcagaattttcaccaattttattgggtacaaaaccaaaatcacgtaagttgtttaaagttagttccaaattgtaggtcttaccgtttaaattaatctttttcattaatgcgtctcactttcattattagtattagagctaattacgtttgttacagttgaattagttgttactcgcaggtttatttgtatcttcaggatagatttgactgtattcatctagacccttttcttcggtagcacttgcggtggtatcacggaagaagttattagcagtagccacatcttcatcactaacagttgcatacccactgactaacttaccatcaacattcaatgtagttttaattgtttcgttgtctcccaccttatcaggagtttcccaacttgagagatatccagaaccatattgagctaaatatttacctttactatctggtgatggtttatcaaagttgatttcccagcaatctactaattcactatgctttgcagcataatgtaataaacgataagttggagaatcagaagctagagcttcaatatcaatagttgtagtaatttcgccaggattgttaactgtaccatctttagtttcagtagtagcaactttcccagcttccttaatagtatgtgtagtttctaatgccaaacgagtagcatttttcttatctctatctttggccaatttaaacattagaactttgcgagttccacttaatgctttttgcatattattttcctttctatctcaaattaaaatctaaaattaatcgtccatgctgcaattgaatactatctgcagtttcacccaaaatatttgatgaactgcctgtcaatccaaacaaataatgattagtagtaatgaatttcgggattaattgctgaatttgctccataatagtagccacttcagctcgataattgtattcagcaaaaacatgaatggttaaattactagtcccagtgacaaaatccttagcatagatatcattattaatttgatctccgaccataataaaaggatatccttggctctcgtctggtaaataatcgaaagtgggataccctgtctttttgcaatattcaattacagttttaaacaattcttcatatggattcatcttgttaaatctcttaaatcatcaataaacttcatccgttctgacataaatggcacaccaacatattttctagctgtccataaatctagttccaaattcaacataagcagcataatttactaatccaccaccataagtaacagaaccagtaaatccatctctgctaatttgaatctgtgcagattgctttaaatgccccgtatcaactggaacagcttgttgagtagcagtcattaaattggctgtatgtttctttacaacctttttaacagtattcatattttgctgattagccaatgcttcatctaaagcatctaatccatcccatgaaatactataatctgccatgatactcaactccgatcaatgtggttattctatccgttgttcgtgcactagttacctctaagttgcaaggtaaagaattagatttaatgtaaccatttcgaaagtccactggaataggcaatctaactacataaggtctttgcttagcatcaccaaaaatattaatggtttgatctaatcccatctgagtgatgttagctggataagaactaactttattagtttgatgtttttcaattagctctaccattttgtcgtatctcatatggattcacccacattcctttattcatgcccgtatggtctttacgccactgatttatttcatcttcccactcatcaaaatcagaggaagcaaaagttatagactctccatcttgtgagtagctggccataccttcatttttaaaacgattaaatttcttaacagctgctccacgaactatagccagcatttcggttgggattacgccagtaatggataaccttaattttaaaaagtcagtagcatcttcaagatacagctttagaagatcatcatgtttagtatcagtcaattgaagagctgttttaagttttttgagctgatcatctaatacatcattcattttgatcttctttcttatcttccccgcctggagtaggttgcttattaccttgcggggttatgctttttttactgatacaaaaataccatcacgtttatgcttcttaataaataaatcatggtataaacgattttgatatagatatccatcgccgtcagtatgttgacctggagcgaataaaaataccgcattttctttcacaattgaaataactgctggttttgcaacaactaagaagttaatcgccttagcatcttcagtcggctttgcaccatcagtaaaatcgtacttagtcatgaatctattagattcatacacttcaatcaattgcacaccatcaatagaagtaatacgtgattcaagtgcagtagttcccacattctgattagtgatatttcgagtaaattcttttgaacgctctaatgcatccatcacttcactagacacataacctactaagttttgagtaccatacttacgtacttttccaatacctgtcttcaattgtgagtaagcatttgtttcgtctaaagtttcctcagtcttatgggtcttagctaacaaagtaccttcagtatcggtaccatcaagattatcaaatgaagtagcgatttttgaaaagcgataagaatctaattctggttgaacgtgttcagtaataaatacattagaaatattagccattgctaattcattatctgtttcatctacatcttgtcgatcaagatagaattcaacatctcggtcttgtcccatcgtataaatagtcttttcatctgaaattgtacctgaattaaagccttttccacgggtatgatcttttaaaccactagtactaatagtctttaatgtaaaagaacgtcctccattgaccaaatcaacctctggcgttcctaaagctgcagtaaataaacctgcagtaatcttttgatctaataaatttccatcttttgttacatagttgaaacctctagtttctgcatctgttggcatattctaaaatcctttctataaacctagagcacgtttcaagtcttcttgcggagttttaagcttatttcctccaattttaggagtttggccttgaagaattgagtttctaccttcctcacgtgctttattaactaaatcaataattgccttggcgttagaaacagttaccgtagcatcattgttaacaaccatattaagaacatcgtcaccaatattcagatctgccttcttaaatatcccattaacttctttaatgtcatttgaacgtttaatttgagcatttaaatcagcattctgtttttttaatgactcaatttccttagtacgttcatcttcttcagtgatttccttagcggatttgctactcttgccccttaactgctcgatttctttcatcgcatcttcgtatttagctttataatcattcttttgtgcttgttctttagtgattcgatcaatataaggttttacaagtgaatcggcatcaatttttttgaaatcatctttattctctgaactagatgctgcaactttatctggttcagtagtagaaactgtttctttcacatcatcttttggcataattaaatgtcctttctataactcacgttttaaagtttcggggaactaacacatggtgttctttaatgcctgcacacaaggaaaaaggcaaaataaaagaccattgaacttaatcaatagtcttaaaacgtattttatttcattaacggcaaccaatctctaacttctttaaagatcttatatgcttttttcatcattgtattttcctctagatattgaaggccatcactagttatataaactctatccatattagaaactatagtgcctgttttagtaggagtaaatttcagccctttaatatagccatcatccatcaacatcattaaggttttataaaattgattattggatattttaaatgtaggagcatccaatatatccaaatcgggattctgtccctcttcatagcaatacttcaaataacttaaaattttataagctacagtaaaatagtcattatgcgccatttatttaacctttcaaaccagttcagcactagaataatcaaactttccttttattagtaaatcaacaatttttttcttgttagcctctacgctttgagtagctcttcctattatttcatgtttttttccatcatcagttaataaatacttatgaccataaatatcattagtgccttgaagtgcaacccaagatagattcttttcaatctgtggcgtgacaattaccacttttagttttttagccatgatgaatccttgctttcttagtcttccaatgatttaaattctgctctaattctttaatttcattatagctgaatttcatggccttagcattttttagcagatatttttgtgcttcaatttctaaatttacagtctcttcctcggaaagctcccacattgcttttttagcatttttaagctgtctcgtatgataaagttcttcttgaattgctgaccttgtagcccaagaagataaagaaatatgtgtactatcgagagttgaagcagacgcacttacactacgaagatgtctatcaacatcttcactcatatccactactcctccacgactaataaatttacgtagtattttatttaggtcgtaagaagacacatattttgtccctggtaaatgataactatttttatgaaataattcagatgctgatttcttctcattatcgatttttttaacatcattgtctttatcgtctacccaataagcagaaatagcacatctacaattaggatgagtttgtgcagggatggtaggcaccttgtcatattcatatacgccactcccatgtccgttgtccgcactaccaattgaagaacataaaagacaggctttaggttcgtttatccattttacaaacctataacctgccttttggatacttccccattgagccatataaagtactctggaaacttcagtattaagaagcctatctgcaacatatctccaattatggacagtatcagtcattaaagactgcattcttttgatatcaaaatgagctaatccagtagcaagaacttgttcaagattagctcttaaccctacttgattagcccataatctacttgaccaattagctccatttacatccgcagtaacaacaccctgaatagctgcattattaagcatactatcgtttttaccacttataccaaggatacctgattgtcttttggtttcagcaatgtatctatccactaaagtgtttcctgtaatagatgcggcattcaaactagctcttgcaacttctaatgcaatgttagctctcagatattctaggcggttaattctcatagtagtgttatagacacgtaactcctgattaactgcttcagaatagtctttataagtaacatgatgaccttcttttcgcattttagccgcttgttcaactaatttcttagccttacttgaataagcttgaacatccatttgtgtcacttgctttttagctaattctaggccaacattacttctttctgccaaagaagatatctctgctgcaatttgctgattaatattatttagcatcgtgtcataatgcttgttcaattgagcaatagcttcttgatcctgttcaatgtatttttcaattgcttctttttccattgcttgacgatcaagccagtacttactactcttcttcagcattattatcacgctttaggatatcaattggcatactcaactgttgcgtttgcttaatggcatctgctttttctttggcaatttgtttcatttctgcatctggttcaatatcagggatcattcctagttgtgtcttcttagagacaattccttcagcattctttgcattatcaattgcactagccatatcttcaggaagatttctagtgaatttaaaatctaattcactccatagttcttgatcttgcttattgttaaacaatgtagcaagtacaattctatatagctgcattaatgacttatcaaacttgcgctctttgctatctgccttatttttcattgcaaatagtttatattgaagagcaacaccactagaatttccagcaaaatttttatcctggatattaggtaccatagccatcataaaaataaaatctgttagatgctgaataagattttcttgcatttgatcagcatctggtttggcgataaaacctatttgtggatttgtatctggatcaagctggctaacatataatacacgattgtttttaaaatcgaatttaggattaccttcatcatcttctggaagcttaaagccaatcatatacatgtaggcattatcaaagtattccacttgattagccttctgacttatcactttatctaatgcattaatcagcgttttaatagaatcaaaaattccctgacgttcttcattttcgaagaactcgactgcaggaaccaatccatatggatttattgcatagccggctgcattagtatcttcttcaatatcataacctttaaatttataaaacttgtcagcatactgaataactccataagcatctgtccaattgttagaattatcaatctgataatgtacaaatgctaaaggctgacgttgtactgtatcatcataaataataaaagcatgattagggcttgaatacattaagtgcggccttgcatcttcgccttgataaatactggcaatagaacgtccaaagatatcacactgcttactaatttcattaatggtatcaaaaaaattttcttgtctattccagcgggcaatttcatcaatttttgagctatcatttaacaaagctagtttaggctcaataccacaaaagtatccattgtacacatcaacgacatattttgctgaattaacgacaatccgattatctgctccagtttccttttctggtgcggttaatatcttatgtttacctagatataacttcatattctctctatatctaggtttcaaaactgtttcgttatatgcaataaaacctaataattcattactagttaatttttctcccttaggaaaaataaagctactgtttccagtaactttatctcttccataattaatatctttcaaaatctcactccctacatgaatgatttaagtagcgtcgctttcgtacttccatgaccattctcttcctctaccgcataacgaatagcatcaatacagtggttatatgcatcgatcggcctatttgtgtattcatcggtcttcttatctttcacgtatgtgtaattctgcaattcttcaattgtcttaacgcaacgatcatcaaccacccatttaaattgctgtagaaattgaattccttgaattattgaatcaggaccttttaatgctggtctaattcgataaataccgtctcttttcatttcagcaattgatttcttttcagcactatcagctgttattacttcttttgaatagcccatatccttaattacttgtgctagctgattattaagcaagccttttttaacaaattcatccatcacataaagtgttttattcctcatatctagcttgatatgcataaaagcacttggatcattgataaatccataatcaagaccaaaataatcatttaacgctaataatttaggatcacgaggattaagtcgcttagtttcaaagtaaggaaaaacaagtttatctaatgttgcaaactcacctaatgtataaatcttgtaataagctggattagtatttttcagttcttcaatcgttctaatattgtcttcatctaaaaatctattatctttgtaagttgattgatggatagctactcttgaccgatcataatctgcactaggatcaaaccaagtctgataagtccaattgagttttgatactgggttaaacatacaaaaaatttgtcgctgtttatgcttaggttcacgcaaacgcaaagtaagttgagtgtagtcattatgattaaattcacttgcttcttccataaccacatcagacagccccttaatggatttaatcttttctggatcatccataccttgaaataaaaaaatcgccccatttggaaggacgattgttttatcagatctatttacatgacagtattgaaggatattccatccacttaaacactcagttacgtcagtaaaaattgaatttttaactgttctatcaaccttacgtagccaaagcacttttcttggaacattccaatgctgcaatgatttcaatacaactttttgtactactccatgacttttaccacttgatgcaccgccataccacacttctgttaagtgcgaataatcaaaaaggttgttaaagatctgtttattaaatacttttgagggatgcggaaaattaagttgaatattaaccatcataatcaccaggatctatgtttactgtaatatcggtttgagtttcaactttatcggtaaaaatcttatagtatttaccaagtaattctaaagcctttaattggtcctgatcttctggagtaacagtcgtgacattatcatattcaactttaggctttttccctttataagaaatacgcttaaaaaccttttctctaggttttccaattgctaactggctcaaattatccagaactccattaatatcaagaatatcgttaactttagtttgatgcattgtttcgctaagatattcagatacgttatcatttgctatcaatcttgatccattagctctcgcttgattatcactttttactttataaacagccttatacgctctagaagcattgaaatcttttaaatattcctgacaaaacttcttctgttttggagttagttctttcaaattatcaccaccttaatttttgcaaaataaaaagccagcttatgctgacttaaaaatcataaattttccagacaaaacttatattgtttatcgtaatcttcaaattcatcaattatattaatactagataatatctctccatctttagctactaaattaattaaaatattttgaccaccaatcccaaccctttctttagtttttttgtcgtcaatatttttttcgattttcattagttctttgaatatatgaattttattatttgaatcgcaattaagcaaataatctatcgcttcttcacactgaggctttaatatccaattaggatttgaataacttgcgatctcctgaatatcaaatttattagtgctcctaagagcataagcatgtgtattcatatcttcatcaaagccgaagatataaattgttgtgtctgtatttactttttcgatattattttttaaaacatctcgaattattagactaaatgttttaacttctttcgataaaattgatctagatctatcaaaagctagtctaataattgaaaaatctccagttccacacaatatgctttgagtaaaaggataatattcaaatttttgagtaaagtaagatggaatagtttttccattgttgttttttctcgatgctaaagtatccatagataaaataatactattaggactaatttcagcatttaaagcagtcataaaatcacctcaataacaattataaaaaaatcaatttcgaaataataggattcattctttgagatgaatataaatttaagctaactaagtccaacaatggtaaatattttagaaccactgctaaaagtttaataatatttccattaaaaaagaactggcctttcgactaactcttatataattatttattcaatttaaacttttctggattatttttcataatatccaaagccggcggttgaagtatatacaaaatcggaacatcatttatatcttctatttctccaaatttagtatatgatacattcttagttttaactattactttagattgatataattcaagaacattaggatcattttcatgtaaatagcctttatattgaggaggattattaaataatttcctaacaatatttagtttttcttctgtgagacctaaaacatattttttatattcttgctgttcttttttcgttttatatcttttccaaattacgtcgccaatatcaaggccaatcgaaatccaaaaaatcaatgctacaaaatatataaaaagaaaacacatagttaatactttacccactggcaatgtttcaatataagatcttgacaacaaaactatcgtacaagtaatagctattagtaatcttgttttcatgtttgacttaagagcctcccatgctgtctttactaattcttccaattaattacctccattcgtttcaaaaataattataaaaaagccaagtctaattaaaagacttgactttcttgaaacgaacggaattttagtcctaagaaggactatgggaaatactggaatcgaaccaagcttaatgtctcaccatttagagatatttcccacttgctctttaacaaaataattttgaagggacattcttaaagaatgtgtgtatgcgcagctaacacagagcaatagcctcaagtgttaaatacataatatagagaggaattctattaattcccatagctcgtacaagaatcgaacttgtgttactggtatgaaaaaccagtgtcttaaaccacttgaccaacgagccagactaggaaagccgcatctcttatgctgcgcttttacgattgttgcagtgtgtgctttacagtttaatgtaggggttacattagtcacatgttcagttcacccacctaccgcgaaaacaatcaacctaataactgtaaaattaaatgacttatttcgtgaatttatcatttaaattactttaccaattgtatgacaaggtaaagtttttgttttacgtccgttttccgccggacaatgagcagcgtggggatcgaacccactgtatattgtgaaagaagattccttctttctaattccaaattgtgtcatactgcccacgactatcgcgcagtccactgaacgatagccaactcttaactacaatacgctcgccggggcgtcgcatatcagtcctagatcatagcgtgacctaggtaagtagcaaataggaatcgagcctaaatgctactgcacatcaatcatgagactatttaacagaaattataaatttaaccaagatgataaattaatgattgatgtgctaggagatcttttcagatctaaaattgtaaaaaatatgaaggattggatcttttaacttgaaaaactcatattaccgtgtcggactttcttactttccgacaatatctatttaagcatagatagttgtcagtaaattaccaccatattcccacaaaaataccctatttatatttatgtaaatcaataataggctggcaattgttcactctttgccaatagtcaaagccatcagcaaattcaaacattgctttccttcgtaaataactgaacttgttgttttcgctataaactaaaggtttaacttcattccatggccatttacgtataaatagccctatcaaaataatttgagaattatgcgagcaatgatgtattgcatcactagtcgcttttaccattgcctcagcattcaatcctctaataatcgctttttcactattattacttccattactatgagcaggagccgaacttaatgtaggagacttaagatctaataattcatggccactcatcaatagcaatcgttccaaatctttgttaaagaattttgctacttcttttagcgtctctttttcatccaattctggaaataaactcactgtatcagctcctagttctattttctatccttctaagccataatctctatatggttcatcatgcgctaagtgatagcgcctgtattcattactcatctatgacatccttaaattcataattcatttcgtctctatcgtatttttcataaatcattaaagctgaaaacgccagtcctgaatcccccatatcccagggagtaacttgatatttaattttttctattgtcaatggaccttctttttcaagaaaatcattgatggcatcttctaaatatttagatgcactttcttcaaataacttaactttcatctttaccaccttgtctttcttaaatcgtatcctgttctagccacttttgtagtccagaagcataatcccttatccagtcactaataacttttccgtcaggcaagttttcccaataatccggatcaaactctacagctattttggtttctaaatcagaactcatgtgatagcccgttctatcatcccagctttccaaaatagagttctttaattcttgacgttctgattttgataaatagcaatcatcattttcatcggataatagtaaataatcattaagctgttcatctaaaagactgtaatcataactccataattcttctgctgcttttactttagaaacaaagtagcctaaatctttactgtattccgcaatatctcgcaaagtgttttgacttgaataccagcagaacactgcaaatccaaaatcaccactaatgcttaacgttgaacttgaccgatcgaaaaggtaatttattcgatttttccattcatattcaggatctttacaagcaagatattctattttgttatcaaagcatttgtattcaaatacgtggttattaaagctcatcttaaaactccaacttaactctcttccgtttattatctgctacccatctagcagttacttctaacattaatttttgaaaatcctcattttgccatgctgacttacctaatagttgactccgtgcatattcttcattcaaggtgtctgcaagcttcttgctggttaatttgctataggcatcccttcgactttcttttttctcctccgcataaaaatcattaaagggattggccaatgctaggtgctttctttttgcttgatagccggctgaaaatacccccccgattaagttaagagcatctaggtcttctaacggtttatgctcatcaagtttctttacaattgttttatcaacataggcggtctttagatcacctagtacatcagatgctactttcatttaatttctctccttatattttctggctatgaagttaatccttgcagtttctagctgcatctctaagcgtgacatagcatatagaactcctaaattcaaaagcgcagttattgtacctttagctattgcacgttgcgcaccttttctatattgcttttgcaattggttaatagtcatttttgcttgttttttcttcaacttatctctttttctcatttttaaatccttacacaaatctcaaaaagatcaaaactatatcaatgattgttaagcaagttattggaacataagacttttgatcgtctctaattacatctataaaaaataaattaattaaaataaaaacgcaccaccattcggcagataattgtccgctcattgtttttctccaaactctttaaagattttgtttctttcttctacagtaatttgcggtgtagaagattgtttaggacgatatgtactccaatcagttgccttacgaacatatttattttgttgattaaaacgaggcttaataggtgtcatatctaaatcatcatcgaatcgaccattaaaccatgtagatccattaagggtatattctagtggggtttgtttaagcttcagaaaacgaatgtatttttctagtttttctttcataacctcaaaagtattgtccttactctgctttcgccaagctttatagtgccttaatgcagctttctttccttgttttttaggatagagtgcccataactgttcgaattctgagtcataaatttgggtcggagattcggaagaatcgactatattatttatactatccttacctaacctatccttacctaacctatgcggtccatttgacgtccattggttgtccactggacgtccattattttcaattgctttaacaccagtcttctttcccgtatctgctcttgctttagcttgctgaatttcaatgtctggtagcattttgacaagtaagtctcgatagatagagtcaacttttctatcggaccgaatgcggttattttctttccaatcatttatataagtaaccagatcagcatttaaaactgttataaggcctttagctgccagaatttttaaatcatcttcagtagagccggtttgtcgcatcacgttatagccttcaaccactccatcatcgtcggcatgtatgcctaaatgaaaatataaggcctgagttgacggaggcattttaagaaaacgggcgctctctactattctttgtgagaacattctacgttgtgccaatcatttcaccacctaaaacaatttatctacttcaggatctttagattctactttcttatcttcaaatggatcctttttaacagtttgccgaattttatcaattgcagcttgtttctccttagtttcttgttttactgaatgattttgcttaaacatttcggcaatttgatgtacagcctgtgcatcttgcggtgtatgtggttccttcagccagtcttgtgcatctttaatgccatctttcgcttcttgataaagatcgtataagttagcttgtatgccattgtaatagactttatagtcctcaagttcttgtttagttaagattttaggttcgtaaatagtcttttgatcttgtgcatcatcgtcattatctgcagcgatcccaaaggctccactaagtgaatatctttttgcataactgataagactggcggttgcttgtgcgtcccaagctttattattttgaaataccaccttattcgttttgagcgtaaagccagaagaatctactaaaattgtttgtacttctacagtattattttcagttctaatatcgaaaaaatagctaaatacgacattgccatctttatctgtaacttttttgataccatccattactgcggcatcaatgtcatttaaatcagcataattatagtcatagctatagggtgtaccttgcttggtttttccagaaacagtaactttatgcgttttttcaggctgtttaatattagccttcacttgtgcataatgcattgcccacttagctctgtcttcttcttttccatagatttccatcttagttcaccctctcatagctaataccccagtctcgaatgaaattagatagggctgttagctgatcggtagtaccagtaagtttaagtgtgacgctatgtaccttatcaactacttcgcctgttttggcatcgacatacttatcgccatgttgttcaagcgattctatagctttcttacgattttcttcttgctgtttagcctgcttaattaaatattcatggtcattatccatttgagttagtacgtcaggtagcgacttataatcaagcatttgaagatatggactagcagtcatagcaggtttagtgtactcactagccttagtagcaataacttgctcagcttcttttctagcctttagtctttcagcaattgctttaaattgttgtctagcttcctcctcaatttttccccagctagctgtcttgttgtcccacttttcttggtaatcaagctcctgtaaaggtatattgtattcaactgcaatcttacccagttgcaataaattctgttgatgtttgtcttttttagctttatcatcaaaagacttaattccttcactgatgtgatcaactgctaccttaattttcaaatcaagtgatttaatttgagcagtaaactcatcaataggttgactagcttgttgtgtaattgattttcttcgctcatttaaggcttttcgaatgcgatttaattctgccctagtctttttatcataaggatacgatttagaagttactacatagctttcccatcctttagctaaatcatctactttagcatttagtgactcgtacccaggaaagtctatttcagcctttttaaaactaattgggaaattttcattttcaaacgtaatcatgtcttttttagcttcgttaatcttattcatgttataattcctttggttttgtattttttgtagtcgttaaactgttggcgcagttaacggcttttttgttgtcattaaatctgtctcaaattgtttttgatattcatccggtataagcggttgtcttgtttctctagtgaagaaagcattactgttactgattaattttgtttctaatgtcatttatctcatctccctaaatatttggaaaaatcgctgtatacatcgtaaaaataagtgctactaatgctgtacacatggtacctagcgtaagtatttctgtttcacgtactgtgaaatcagtacccatgaattcgttgatcttgtggttaatccatttactcatagtttgtgatcctccataaacttttgtaagacatccttgtcatataagatttggccatcaatactaattggcttaaaatcaaactttttcagccaaattctaaatgtagatgggctaactcctaagaagtttgctgatgctgtcacgttaaaatacttctgttgaatagctctttcaataactcgttctgggattgcgatttgcatgaaatcatctcctttttaatgaatcaaaatactttccttactagctctatctactccttttacagcaagataagtttcttgctgaagatggataaaacttagaatatcttgaatttcttctggtttaccttctagtgtcaccttcatttttatctcctctcaattcatcaagactaacgcctaacgcatcagcaattttgcacatagttttgaatgtaggctcagtctttaaatatctataatttctaattgtttggtaatttattttcgattcatttgataatttacgtaaactccaatgcttattttttaaaatacgatcaactgtttgccacgacatatagtgttatcactttcctatctactttatattgtgttatatttgatacatgatattttttagaaagaagagacatagtggcaactcaatataaacaatctatctgcttaaatggtcatcagattactgatgaatttagtcccaacgaaaccgtaactggctattgcgaacaatgtggcgctaagcttattgatagctgtccccattgcaaatatcctattgaaggattttattatccagacggagtagtatatttacgaagtccaaatgataaacttccagtacctaaatactgtaaaaaatgtggcacaccatatccttggactaaagattctttagatgcattgaatgaagtaatacaattgtctaacctatctattcaagacaaagaatctttacaggcttcaactcctgatcttttagttgacacacctagaacaaaagtagctgttttaaaatggaaaacaataggtaaatccatattgaacttagctcacgacattattgttgaagtagctagtgaatcaatcactaaagcaatttatggaaactaatctatttccacactgttcacagtaattaccatcgtgaacgacatgatgacaattgctgcatacagctaaattcatcaacttaaagtatctactagcagcttttataaaaataagctgcttttctttttgctctttttccattgcttttacctacacttctacttttctaagcttattaacagaatactgttgccccttacctgttaccttaggtgtcttgctaattgatgttgaaccgtttgaatggttaatcgttgtttctttgatcttgaacaaaccaagatccattgatttctgcgttggcatgttccaatcactacccttacgattgatcagatatccatgttctcgcatccaagcaaacaaacgattagctccaatatctattccattacctcttaaaattttggccaactcgccaatcaaaattgtagtgtggctagttgctactgaatctgcaaacaatgccttaggtttcatttcagcaatttcaatatctttttgtttaagctgatccgctgcttgttgaagtaagtcagctaacccggtcttgttacggactacatcgaatgctttttcgtcagtcatatatgcaccgtgtttgcgaattgctggaagaacttctgaagtaacccatcgtttgaactttttagcattgggaagcttacttgataagatcaaactgtacaatcctgattcgttaattaatatttgatctctcatctgacctgcggtactgatttggtacctcagcttatcttcctcgtcaacgtgagtatttatatctctactaccattcttatatccaagaatagttgctacatctttaccaacaaaatatggttcttcatcaactgtcaaagttctaacttgttgattttcaaaattaaataattgcagtttattttccattcagtttctcctctcttattgttcaaattaattttgaactttttcatcaaaaaaatattctgcaactttagacctatccaaatcgagtaaatccattgcatgtgcaatttcatttgttttccaactaactcggttatttagcttattagaaagactatgttcagataaacctagtgcttttgcaaaattatattgagttccatatttttcaataatgcgcccattcaattttctaaaatcaaatgccatacctatctcctttctcttttgttcaaattaattttgaactttacacaaactataatacactcttaaaaaactctgtcaacatttttcttcaatttttttgaactaaaaattgaactaagttcaagaacatcatataattaaaatataaaattataaaaatataaaggatgtgagattaagtggaaaagaatcaaaatgcagataaagcagaattatactctggaaatcgagctgcagttggcgaccgtttaaaagaatacatgaaagaacataacctaaaacaggtagatattattgaaaaaactaagcctttctcaacttctaagcttaagattacaaaaactgatttaagtcaatatgtaaataacaaaactgatcctcgctccgataagttacatttacttgcaaaatcattggatgttgatgaagcatggttacttggctttgataaacacgcccataaaacttctcatcataattccacttcaagggatgaaaatgaaagtcaacaagctgacttagacgatggcgacaccatatttacttttcaggggcgccctattccgccagaggatttaaaaattataagaaggttgcttaaaaacgatgatgaataatttaacagttacttatttatttaattacgcaatggctcatgatattcaatttgaagctactcacttacttcatcctggcaccccttcttgttgcaatactactaaccgaaaaatggtcattaatcttaataatgacgaagaaggtttaccgttagaaatagctcatgaaattggtcatatttttaatggagacaaaggtaaattttattattgtggtgatagtcgttcatcccctgtagaagtaaatgcacataaaacaggtattaaaattcttgccaattattattttgaggatattcctaaagaagaatggaatgtagataattttatgtattattactgtattccaccctcttataaagattggactattcaatatttaaaatcgctataagcaataattgtccgcaatgacgttaaactaaaaatatataagtatggaggataaaatgaaaaagaaacttgttattgcagttactagtttggctcttttagggatggtgactagcgcttgttcgtccaacaataattcaagtaatagtagtaaatcatcttcatcaaaagtaaataagcctaagaaagtagttccatctgataaagcaaaagatagaacttggacttataaaaataaagttttcgatgctggaattgaaacttacaaatttactaaatctgaaataagagattctgctacagaaggtaaaaaattattagttctttattgtgatgtaactaataattcaaagaaggaacaagatccatctaacgtatacatggtagtccatgcttatcaaaaaaatgacacttctaatattcaattagatcctggctcagccgcattagatgataatggcaatgatccattacaaacttattctgataatttaaataataaattgttacctggtaaaacaactaaggcttgtattgcatatgaattaaaaaatgacaatccagtaactgttaaattcgaaaattcagattttgatactattggtcaaggaatctatcaaattaaataaaagctggtgattgttaatgcgatcattcattagaaaaccatcattaaaaaaatctttttctgcacgaactaaaggcagagccactcgttcaatgaaaagaatgattaacccaacctatggtaaaaaaggtacgggaatgctgacgaaccctaaaaagagtatgtacaacaaagtttattcacatacttcaattagtgccatgcctaaaggcagcaaaaagaaaatatcccgtagccactcagatgatggttgttggggatgtggatgcttaattatttttatgattattgtatttatcgtatgtttgttagtttaggagaaaaaatgggatttttatcaaaaagcagaaaagctagtgggaaaaatttatatgatagcgatgttaaaccacgtttagtagaaaaagatggtaatactcacattattatgattaatagctttagtaagtttctagatcagaactttggcgtagaaacaaaatatacagaacaaattggatctgtagttgattcgctccaaaacgatggctatgaaattgtagatattaaatttgattcattaaagggtcaaggtatcaccggaacagctgaaggatttcacactttaattatgtataaatagatgcacaaatataaggtaaaaccaatgactatacaaaataaatacaatgtttctgtaatatcatttaaattaacagattcttctggaaaacaaatttacactcttccttttaacacaaataaaaaggagtacaacaaggttgattctgaatgtgtagtatatcttccgaataactttatagaaaattttccaaatgcagaaaaagtcttcttccatttatctacttatgaaaaaatcagttttgattccggtttactttatcaagagacggctatttctgttaaagagctgccagctaatggattacttaaattgaactttaatatgaatttccctagtgaatttaagccttataaattggttggatacaggttttctgtttccgacaaagatgctatgcatcaagtgaccgatgaagatgaaaatgagggtgttttcttcgatacagttattccttcagaggtaattgacaatggctaaaataaccacattacccactgcaaaagcattttatcctaaagacttgaagaaaccctcaagactatctgataataatggtggaggtgaaccacctatggataataaatatgtaactcatcaggaattagaattaagcaacgaaaaactcctgcatcatatggataataaattcgctgagatgcaacagcagatgaatcaacaatttaatgaagtggataaacatttcaacgatcttgagttaaaagtcaatgatattaaaaatacagcaaataataacaaagaaaaaataaactggttattatataccgctattggtggaattattatttcagtaatcactacaatcatttctaatcttttaacaaaataacttaatccatgaattatagctatttttgaatgtcacaaccagaataattagtataggaaaaaatgaaaaagaagtatgttattgcagcaagtttattagtagcactgggaatgtctactgcggcttgttcatcaaattcaaataagtcaaattcaactgttcaatcatctaaaagtgtgcataaaaagaagtcaaccaaattaccaaagcctgattatgcaacagctgaagatgccgaagcagcattaaatgcaggaaaagttcttgaaggtaaaactgttcgttttagagtaaacgatttaagacctaaaagtgcttttggatataatttagaaactggcgagcatttaaactttgttagtccacataatccaaaagtaaaagttggcgatgtagttattgttaaagtgaaagaagtaacgtctaccctaggatcatttgttattaagtattcaagtctgcgtaaagtaccgttaaattctttatctaaggcagaaaaagaaaaattaattggaaagactgatacagaaaataaatcaaacactgagactaattcttccagtcagcaatcttcttcccagcaaactactgcacaatcttcttcatcaactgttcaaaatagtaacacagctaagcaacaatctaagcctaaatcacaaggcgagattaacaaggaacttggccacgatccaaaaggtgccccactcttaccaggacaagatcatgctgctggcgcaaacgtaaatggtgatcctgatccttgggtacagggacaaattgattgggctattcgtgaaggttacatgaatcctgacggaacggacactgaaaaaggtaaacaattattacaacagggttctgatgatgaagacgcagattccaataattctagttacgatacaaacgatgatgattcaagttatgatacggactattaaaaaataaacaaaaatcccactgatgcgccaacatcagtgggataaggaaatgagctacgccaatagctcaaattaatgttttaaaattaacaaagccataaaaatatgaactctgccctcttattgtagcagagttcatatttaggctacaataggaggttttttattatgccaaaaagaaaaaatacaagtattaaagattataaattaaaatctggtaagaaacggtatatgtttcagatttatttaggtactaacagcaatggtaagcctatcattacccgcaggcgtggttttaaatcttatgctgaagcagaagctgtattcaataaaatgtcacaaattaaaccagataattttgtaaaacaaaaacaaattaaagtagctgaattacgtgaactgtggtttgaaaattataagacccaagtaaaagaatccactgcaaataaaaataaacaagtctttgataaccatgttattcccgcttttggtaatcagtatattgacaagattacagtggctgaattacaaaagtgggctgatagaaaagcaaaacagattgttaaatatagagatgctattaatgaattcaatgccctttttgaatacggtattcgcttaaactatgtttctgaaaatccgttaaaacggatcattattcctaagaaaacatctcgaccacgtagagacactgaacataatgtttatacccaagatgaactaaatcaattccttgaagttgcaaaagattatggattggtcccgtatacttacttcaagctactttctgctactggtcttagaaaatctgaagctctcgcgttaacatggtcagatattaacctaactgccggtactttatcagtaaataaaaccttggcatatggtttaaatggtaaaacgattattcagccacctaaatcaccaaaatctaaacgaattttgccgatctctgacggtttgaaagaagttttgatagattacaagcgaaagcagaaaatcatctctaaagagctatttcacactaataagggaacttatttaagaataagcaaaccggatcaatggttaaaatcaatttacgctaaagaccacgaagaaaaagctgaatatgcaaaaaaatataacttaaaagagccacaaccggatttacgtcatattacagttcacggttttagacatacttttgcaacactacttattgcggaaactaatgtaaaacctaaaacagttcagatgttacttggtcatgaaaacattcaaatgactttagacatttatactcatattaacaagaaaaatacagaagatgcagtcaatgcattaaagcaattaaatatataaacaaaaaaacaccttttttagccatttcttagccaaaaaggtgtttttattacttaaaacattgctatatcaacattcttttattcaaataaggagagtacaggatttgaacctgcgcgccggtataagccggttcgccggatttcgagtccggtgcattaccactctgccaactctccaattacaacgtttttattatagcaattaaaaaataaatggtaaatacaaaataactaattctaaaattaatctttaaaaagtcatcattctttcatagtttttctgtatcttaaagctatactaattgataatgaaaggactcgtattatggcaaagatcattatttacaagccccgcaaaatcaagttgatgcgccaggctgttgagcgttatctaaactataaaattgttaaacataattagattttttagccaaccaaaagtggttggcttttttaatttaaaacatttcaataatcttttccattagtggcgtcacctctctatctttacgccatactaaatttaagtgggtaatccagttagtatgctttactgggataatcttactttttgcataagtaaaggcaatcgattccggaactaaagctatccctaaacctttatccgcccagtgaattgctgttcttgcatcatcacaagttactgaatagaacggccttattccctgatgccgaaaactacgattgaatacttcttgaaatcttcggtataaaattatcggcctatcttttaattcatcaagatgtttaatttctcctctttcaaaaaattcttctcttgtcactgctaccattggttcctggtgaaagtctttaaaatttagtccttcaagattaaaaggtgtccgcactattcctaaatctactattccgtcttgtagttgttcaacaatgccaaaagtatttgcttcatgtatttcaaaggatacattaggatagtattttactaatttttcaaattgctcgtttgggacaactccaccacaagaagaaatgactccgattctaatttttcctaattcaccctctttaatttgatggatttggcttttagcagatatactcagagcaacaattttttcagcatatttttgaaatacttttccctcttctgttagttctatcccatgagcagttctaacaaaaagctgcacccctacttctttttctaattgttttaactgataacttaaaggtggctgagcaatatataactttttagcagctgacgtaatctgccgctcttcagcaaccactaaaaaatattttaattgtttaatattcattattaataccttttaacttattatctatatttttaatatctcctatcttaatttgatattttcttaataacaagaactgcgctaaaatattttaagaaaatagagaattaacggaggatttttatggaaaataaagaactgcaagggttaaccgatggccaggcagaagagcgtcttaaaaaagatggtctaaatgaagttcccgaacctgaatttaatttctttaaagaatttatgtccaagttatggaacttatcggcctggattttagaaggagccttactattagaatgtattttaggtaaatggatccagtccttatttgttttattaatgcttttatttgcagcgtttaatggagctacacaaaagaaaaagtctcgtagagttttaaatacaatttctcatgagctaactccaatagtctctgtaaaaagaagtggtaaatggaaacaaataaattcaaaattccttgctgttggagacttaatcagcttaaaacgcggagatgttttagcagctgacgtaaaaattgctcaagggcagattacagttgatgaaagctccattactggtgaatcaaaagcaattaaaaaatctgtcggtgataccgcctatgccggaactaccgtagtggatggagatgccctagcagtagtaacggcaacaggaagcaattcccgttcgggaaaaactattaatttaatcaacaattctgctgctcctggtcatttacaacagctattaaccaaaattatctattacctctgtctcttagattgattctgccattgatgaatacctaaaagaaaaagatattagtcctgatactccggaaaaatttgtccccttcacatctgataccggatattcaatggctattgttggtaactacaatattaagttaggttcttttaagcaactttctttaatagataaaaatgctgataaagaagctaaaaatattgattttactgctggtcgttcagttgcagttctaattaatgacaaactagctggaatattcattttacgtgataaagtcaggtcagattcaaagaaagctctagaagaacttaaaaaacgcggaatcaaaccaattatgttgactggagataaccgcagaactgcagaagctgttgctaaagaggttggcttaaaaggaaaagttatctcaattcacgatttcaatgataaaactgacgttaatgatttagccggaattgctgatgttttaccggaagacaagcttaagatggttaaactattccaaaaagatggctatattgtggggatgactggtgacggagttaatgatgctcccgcattaaagcaagctgaagttggaattgccgtttcaaatgctgctgatgttgctaaacgaagtggtaagatggttctcctagaagatggtttaactccaattgttaaaattctggacgctggtcatcgagtttaccaaagaatgacaacctggtcattaaccaaattatctcggacagcagaactaacaatgcttttaacatttggttacctatgctttaactatattccaatggcattaaatgcaatggttatttataccattatgaataatatggtaactatgatgattggaaccgataatacgcatattacctataagcctgaaagttggaatatgcttaaattagctaagattgctttctctcttgctgcaggatggactgtaattggttttggctttgtttggtaccttgtatctcaccactatgctcaaggaactgtttctacaatggtttatgtttatttagttttaagtgcaatgttgattgtattaattactagaactagaaaatttttctggcagtcagctccatcaaaatcagttgctatagttcaaattattgatgtcttgctaacttttgctttagcattattgggtttagctatgactcaaattagctttgcaaatcttggcttaaccataattgtagctttaattgcagcaattataattgatttattctatcaaccaattatgaaaaacaagtaataacccatactaaatccatagaaaaataggttactttgatatgtttatcagagtaacctatttttaataaactttagtttttatatgtttccttaataaacagcacacaaactgctgctaaaatacccgaaattcctgcagtcagcatcatcgccggcattgaatatttcattagtggaaatagtataaagcttaataatgaagcaattatttgaggtaagcaaatggaacaattaaataaacctaaatacgtccccatgtgtttaccggataaggcattagaaaccatagttagtggataagtgttcatagctgcccaagaaattccaattaaaataaatgatacaatcaaaatattttgagaatggacaaagaagatggaaccatatcctattgctcctaataataaactaataccatatccaaccttatgatgatcatttggcacctttgccaaaacatatgaccatatcactgcggcaattgattgaacagctgttaaaaccccaaaccagtttccggctaattgataaccagccgaagatggatctgttactttccaaacattttctgcaattgcacctgtagcataagttgataaatattggaatgaaaaccaacaaaataattgtactaatgaaacttgccagaaaactttaggtgccttttttaacagttcaaaccagtttccgccttctttgttatcttcttctttaataccatgataacgagcataagtttttggatcatattcatgaacttttgttacggttaacaaacttgtaatgacaagtattgtagctcctacataaaatgaaattacaactgattgaggtactacaccctttttagcagtattagcaactcctagaactgttaatagaaatgggaaaaatgctgcaattactgcacctgaatttgaaagcatactttgtataccatatgcatatgatttttgctcatcattaaccatatcaccaatcatcattttaaatggttgcatagccatatttgctgctacatctaaaattgcaattgcaatagctccaaatactaatgcttcaatagagccatatcctaagcctaaactcccaatgtttggcaaaaataacatcataatcactgcaaagatcatcccaattaataagtaaggtaatcttcttccaccaagttttggagcccaagttcggtcagagaatgatccaatagctggctgtaccactaacccagccaaaggcggtaaaataaagaaccaccctagcttagttggatcagctcctaaggtttgaaaaattcgactcatttgtgatgtttcaagagtaaaagcaatttgaatacctaagtacccaaaattaatcatccagatcacactttttgcaagttctggtaagccagatactttgttattttcatccataattttctccctcacttttagctaagcgctttcaataattttatattaagcaagagtgaaaatgctttcaatacaggattaattgttaccggtaactaaatacataaaaatgctgataccattacaaaaaagtaataaatatcagcatttctaaatatttataagtgaggttcctcatattctcttatactctaaaaagtcgtaatcaaatttattatttccatttggatgatgactttcggaatttactaatttaaagtcttcatactttagttccggcatccatgtatcacacttaaatatatggtgaatttttgtcttttcaagaacatctacttcatccttaaattctttaaaaacttcagcaccaccaataatatcaattatttcttcagtgtgatcttcgatccaatttttcaactgttcaatttgtgaaaaaactttaacatctgaattatcttgatatctacgttgtaaaattggattagtagaaaggatgatatgttttcttttaggaagtaatccgggaaaactatcaaatgtttttcgtcccataacgataatatgattactagtcagctctttaaaatgttttaaatcagcgggcaaatgccagggcaaagcaccctggtaaccaatacatccattttcatcttctgcccaaataaatctaatcattgttctgtcctcaacatttaaacggctaccggcgccttaatagtgccatgatgccggtaattaattaacttgatatctttcatttcaaaatcctgtactaattttttatccggatttagccaaagcataggagcgtcatatgcagatcgattcaataattctttaacttggttaaagtgatttttataaatatgagcatcccctaaggtatgaataaattcacccggctttagtcccgtttcacgcgcgactaaatttactagtaaagcataactcgcaatattaaacggtacacctaaaaacatgtcgcctgatctttgatacagttgtaaacttaaacacccgtcattaacataaaactgaaacaagacatgacatggcggtaaagcagacgttggtacatcttcgggattccatgcgctaacaattaagcgacgagaataaggtgttttcttaatttgatcaattacattttgaatttgatcaataaagccaccttcacgcttctgccaatgtctccattgagcaccataaacgtctcctaaatttccatatttttctgcgaaagtttgatcttccaagactttttgatcaaattttttcatttcttcttgatatattcttttaaattctgggtcttgttgacttcttagaccaaaattagtcatatctggcccctgatattcattgctctctacccaatttttaaaggcccattcatcccaaatatgattattatgttctagcaaaaaacggatattagtgtctcctcgtaaaaaccataacaattcgctcttaataagtccaaaaggtatttttttagtagttaaaataggaaagccatcatttaaatcaaatctcatttgggctccaaacaagcttctagtacctgtaccagtcctatcttccttgtcatgcccttcactcattattttacttagtaaatctaaatatggttgctctaaagttgccattttatttcttctttctattccgcgtcctcatcttaaaataccatatattttgtatcttggtaaatacaaacactacattttgtatattcattgatatggtagaattatatattataaactttgggggaattctaatgattttaacttgggatataattagaagaataatcgaaatcctttggttaattaatgtcggtctagcaatttggacagtttttcgtagtcatcgtgatattgcttctacttgggcatggctcttgattttgtctatcttgccttatgttggttttgttttatatttatttactggtcggcaattatcacatgatgatatcttttcaattgaaactgaacagaaaaaaattcgtgatcattttcttaatgaacaaaatagactattaagaatccatgacttgctaccaagtaaagcccagaatccacgcgcaagacgcttagtagaactgaatctaaataatgatgatgcccttttaacttttaataacgaagtcgagacttttatcgacggacaagctttatttccaaatcttataaaaaatattgatgaagcaaagagaaccattaatgtagaattttatacattttatgatgatcaattaggaaatcaggtcttacaatctttagaaaaagcagccagtcgaggcgttaaagttagagttttatatgatgcaagcggctctcgtggtacacgaccatctttttttaaagaacttcgtcaactaggtggagaagctcaacctttcatttcaacagctggaaaccgtctttttactactcctcgcgctaactatcatttacacagaaaactggtaatcatcgacaatgaaattggatatattggcggcttcaatattggtgatcaatatattgatcgaagtaagaaatttggacactggcgtgatacccaccttcgcgtagtaggacaagcagctttattaatggaaattcgctttgcaatggattggaatactagttgccgtaaatctcatcttccaaaatataatattgataacttaattgaaacatttgaattaaaaatagttcaatctaaagacttggtcccaatgcaaattgtttcatcgggaccagataatagtcactttggtattcggcgagcttatgaagaaataattgctcaagcacaaaattatgtctacattcaaactccctacttaatcccgggtgattcaatcctggaagctttaattattgcagcaaaaagtggagttgatgtacgaattatgatcccttctatgcccgatcatccctttgtctaccgagcaactgaatactacgcaaagtacctagttaatcaaggagttaaagtttataaatacgataatggatttattcatgcgaaaactatggttagcggttctaatattgcttcagtcggatcggcaaatcaagattttcgtagttatcaattaaactttgaagtaaatgcttttacatatagcgcagctctcaccaaggaattaaaagaaatttttgaagaagatttaaaagagtcaactttactcacaaaagagtactttgacaaacaatctcattggcgtaaatttaaacaatacttttcaagattattatcaccaattttataaaaaaagagacatcctcaatttttagttgagtatgtctttttttcttatttattcttcttcatcaactacagtaacagtttttctttcttgatatgaataatatatccaagcgataacaccaaatgccactggtccaatagcggtccagaatgaagttgcataatcaccagtaaataatggctcaatacaagtaaagacgatcccgactgctactacaagccaaacaacaattgttacagtccacacacgttttttaccctcaataaagataaatgggcgatcaatatcttttttcatcttaaagaatggatatgcaccaatcagaaataagtatggggcagatgaagaaacattcatcatatccattaaaatagtatagaattgtccggctgcgttaccaccaaaggaaataaataaaataataacactaacaataacagcctgaagccacattgaacgctctggcattccgtgtcgatttaatttaactaaggattttggcaggagttttggatcacatccttcaataaaggacttaacaggtgaataaaccattaaaaatgctgctgaaattcctgctaaaacgtcagctaatccagcaaaacgggaaaaagcagatcctaaagctaatgatgctgaatgagaaagtccaaatgctttacctgtttcaactcccaaattgttaattaaaacatattcaacattagccaaatcaacatttttaccacttaattgactgctccagttagcagctacaccacacatcaaaatatttaaaacatataatgccgtcatccaaatcattgcagtaattaaagccttaggaaacgttttttcaggtttatctactgaatcaatcacaccagctgatgtttctagaccaccgtaagcaaacaaagcataaacaatgaaagatacaacggcaattggagattggaaagccggattaggtgaatgaactagtgattgggccgttaaaggttctgctaactttccatgattcaaaaagaatactaagattgataccaaagtaaaaccaattgtaatggctaaagtaaaaaagcctccaacgttacttacagctgcaatcttatcaacacccttagcagcaaagaatgttacgactactaaaaatgctacttctaaaattcctaaaagttgtgttgatgtcaaatttaaaaagtgccagctttgagtagtatcatggcctgaaatggctgttgataccgatactaagaaaaattgtgtcgatgatacaagccaaaccacccaagcagctaaccaaataaaagtaccgataaaagcagttttttcactaactgagcctttaagccaagaaaaaattccgcccttagctcctttaaaagctgcaccatattcggcaaaaattaaagctgatggtaaaaagaataaaattgcggttatgatataccacacaatacttgcataacccatttggtaataggctgttaaagaattactaaagccaaaaatagctgaaaagatcatcagaactagactctttagcccaattttgactgatttgtcttttttcataaaaaactaaaacactccctctttcatacaaacattaactattatgcgctttttgttaaattaatacaaaagagattaaaaataagcaaaagaaaacggaactcaatcgagttccgttcaagcattaagcatcactgtactttactaaagaatatatgtctaaatctgggaattgttctcttcccttaagatcagttaattcaatataaaatgctgcccctactacttctccgcctaagttttcgattaattccttagttgcgtgaagagtaccagcagttgccatcaagtcatcacagattacaactttttgacctggcttaattgcatctttatgcatttctaagacattagaaccatattctaaatcataagaagcactttctacttcgcgtggcaacttatgaggcttacgagctggtacaaaaccaactcctaattctgttgcaacaggacagccaacaataaatccacgggcttctggtccaacaattacttctgctccacgacttttagcataatcagctaattcatgggtagcagcgcgatataatttcccatcttgcaaaattggggtgatatcgcgaaagacaatccccttatttggaaaatcctgtacacttgcaatgtgttctttaaaatcaattgccatttaaagagaaacctccattttagactctcattgaaaaattagacctagcggtctttgacttgtatattttaccaaatttttgctttaaaatcaggcttaaaccgaactttttaataatttataactagtaatgatcacttcaaatattgtttaacataattaatcaattgatttgatggcatcgttcttaactgattagtaaattttatctgagaggatatactattaaaatattttgaagcagttagttttttactttcgggattcttattcccgataatttttccatcagtaaatgagacaaaattcaattcaaaaaatacacgtaaaataaataaaacagcttgataatctaaaccaagataagaagatacagcctggtaatcatcaatacttaagtttggatgtgcatagatatattttaaagttgcaccaaaagcatccctacttggcaaagtattgattggtaattgatcaaataaaaagcgtaaataaagctgttgatactttttctccaaagcaacatttaactccatttgattgcgtggcgtatctaataaagctactacttcagaatctccattgtaatcttttgctagactaatctttccttctgggatccctaatccattcctagcccacggaataatctttttatcaaaaatcaaatacttatcagcaaatcccatcacatagtcttcttgccgcatatcaattacttgatcaaaaacagctaattttggagctccatattcaatccccgctagcatcccttgaacattcgaaatatttttccagctattaagagaaagagtaacgtaaagttctttaataaaaggaagtaatgtttgatttaaaaatcccttgttaaaaccaacaattgtaagcttccccgcatttttttctgctgtaaactttacatgatttttatcttttcccattttaaatagactcttaatatggggctcactaatactaaaaattggttcaggattacctgttccaaatggaccaaccagattaatctcagctatggtatcaggcgtaacttcttttaaatttaattcaaagtcaaaatcttttacctcaagatcagtacttggtttaaagctatcctcaaagcgtactcgtaattcttcaagcttgtcggcttttaaagataaaccacaggcaaaatcatgaccaccaaatttatctaaaagatcatccttcattggctctagagcattaaacaaattaaatccttcgcttgatcggccagatccctttaattcacctgtttcatccttagtgaggacaagagtaggtttatgcaacttttcgaccactttgtttgctacgagtcctaagacaccttcatgaaaatcaggattataaataactagagtatttcgatgctgccagccattcttttcaacttgagctaaacaatcgtcataaactttacttgtaagttcttttctctcattatttaattcttcaatcctagcggctattttttcagcttgttcttcatcatcacttaaaagtaattccacggctaaactagcatctgccaaacgtccaacagcatttaatctaggtgcaatattaaagccaacatctgttgccgtaatttctcccatagttagacccgcttgtttaatcaaagcgcgtaatcctggtcgttcagtttgattcagaatatctaaaccacgttttacaataatatggccttcaccagtaacctttaccatatcgccaattgttccaatcatggccaaatctaatagctcaggcattgtatcttgcattaatgcacggcaaattgtatacgcaacccctgctccacaataatcatcaaatggatatttctggccaggataattacagtgaacagtactgaaggctgctggtttttgatcttgaaaagtatgatgatcagttaaaatcacatcgacaccatgttcttgagcgtactttatttcttctacaccagttacaccattgtcaacagtaataattaacttagttccatcttctactatctcttgatagcgagtcatgttcggtccataaccatctttaaatctatcgggaataaaaaaatggacatcggcacccaaaatttccaaagtatccatcatgatactagttgctgtgattccatccgcatcataatcaccatagatggttatcttttcaccattatcaattgcttgattaattcgatcaattgtcttttccatatcatgcatcaaaaaaggatcagctaggtcattttcatccgcatttaaccaaaaatctaatttttctgcagtatttatccctcttaaagcaaaaagtttagcttgaatatcagttaaaccataatccttaattaactcttcatctaaattatttgcttgtctttgttgccatttcattattttctagttcacctaaatcatctataaacatctaagtttctattatagcaaaagttaaaaaggatttacttcctttcattaagaagcaaatccctttatttaagcttgaaaacttgaagatttttgtccgttgctggttcttccgcaattaattttcctctaattgcccaacgattaaccccaccatcagcacaagtaattaaagtaacaatattttgcttagtattatccactagccaaactgctgttggatcaacaatttttttcatatatattcgatagacataaatcttatctagattagtcaaatatactctttcacctattttagtgttttctagtggtgaaaataatactcccttagcagtcatatagtgtccagctaacggatagtttccctttcccattacttgatcaggtctcatagttcctccgccagttgacatggcatcgtcgcttaaccctttcataattggtaagtacatgtttacgctgggaaccgcaatcgcgccaattgcatccgctgtattattgacacgcgattttgttacttgaccaaagtcgatttcctctaccttagaaaaatcaaacattccttttttcttttgattctttttaacagtttctttattcaacttttttaaggcagtcgtttgattttgtctaaccatcatatctcggatctgactattgaaaatcatccctaatccgataattaataaaataattgcagcaattctaatgatccaagttttcttggaattatttttctttgtttgtgccattttttctattccttaattaattgatactgttataaattctaacacaaatttagaaaaagaatatcaattaccttagcgatagatttttaacaaaaaagacgtaccaaaaccttggtacgtctataaagttatgttatttatttacctttaatatcgtcatcgttcatttttaaaacagccataaatgcatcttgaggcacttctactctaccaactgctttcattctctttttaccacgacgctgtttctcaagcaattttgcacgtcgatcagggtcaccggtatgaatcttccaagtaacatctttacgatatggtttaatggttgcacgagaaataattttagctccaatggcaccttgaatatcaacttcaaagttctgacgcggaattaatttcttcagcattgttgtcatttgacgagcacgattttgtgcttcttcacggtgtgcaataaagctgagagcatcgataggttctttattaagaagcatatcaattttaactaagtccgttgcacgataaccagttatctcataatcaagggatgcatagcccttagttgaagattttaattcatcaaaaaaatcataaataatttcggctaatggcatattgtaaataacatttactcgatacttatctaagtaatccatagttacaaattcgccgcgctttcgctgacataattccattactggtcccacaaaatcatttggcaccataatttctgctttaacataaggctcttgaacttccttatattcaccagcatcaggcaaatcagctgggttatcaatcagcttagttgatccgtcgttcataatagcatgatagtctacacttggtgcggtcatgattaaatccataccaaactcttgctcaagtctttcttgaacaacgtccatatgaagcaatcctaaaaatccacaccggaaaccaaagcccaaagcttgagatgtttcaggttcaaattctaaagcagcatcattcaattgtaacttttgaagcgcttctttcaaatcatcatacttttgattgtcaactggatacataccagagtaaaccattggtggaatttgacgataacctggaagtggcttttcagttggagtttcagcactagtaatggtatcaccaacacgagtttcacgaactgatttgatgttagcagttaaatatcctacgtccccagcaataagcatatcttttttaactggatgtggacttgaaacacctacttctgttacttcaaattcttttccagtattcataatacgaattttatcgcctggtttaaccgttccctcttcaattcgaacagataaaacaacaccgcgataatcatcatattttgaatcaaaaatcaaagcctttaatggggcattgaggtcaccgtcaggtgcaggtacttttttcacaatttcttctagtaattcaggaataccttgacctgtttttcctgaaacttctactgcatctgaagcatcaagaccaatcatctcttcaatttcatttttacacatttcgggatcagctgatggtaaatcgatcttattaataactggtaaaatttccaagtcatcatcaatagctaaataagtattagccaaagtttgtgcttgtacaccttgagtggcatccactactaagagtgccccctcacaggccgctaatgatcttgaaacttcatatgaaaagtctacgtggcctggagtatcaattaagtgaaagatatatgtttcaccatctttagcgtggtattttacttctacagaatttagcttaatagttataccacgttgccgttctagtggcatatcgtcaagtaattgatttttcatttgacgttcagaaacagtatctgttaattctaaaatacgatctgcaatcgttgattttccatgatcaatatgggcaacaattgaaaaatttcgaatatgtttttgataatcttgtaatttttttatatccatgttctcacccttttcgctttattaattatatcaaaggcctacgactagataaaattcttaatgcaacatttttattgaagtaattatttattacaaaaataaaacgcatacctcaagacttatagagatatacgttttcacttttattctccgtttaacttatcttttaaacgttcgaagaaattcttttcttgtggggaaatattaccgccaccagctttaacgtaatcaaccaaagcttccttctgcttatcattaatcttctttggaataactactttaactgttacttcttggtctccattgcctgtaccatttatctttggtacaccttgaccacgtaatttaaagttagtattaggttgagttcctgccggaatcgttaaatcaactggaccatgaactgtatttacacgaattttatctcctaaagctgcttgagcaaatgaaattggagcttcagtatagatagttgtaccatttcttctaaattctttgcttggtttaactctaaatacaatgtacaagtcaccgtaaggaccaccattttttccagcttcgccttgaccacttaaacgaatctgttgtccattatcaataccagctggaacagtaacttgaagagtctgctttttgtcgacggtgccctgaccatggcaagtttgacatggatgttcaataattgttccgcgtcctccgcacttgtcacaagtagtttgttgttgaataacaccgagtggtgtttgacgagttaccgtcattaccccacttccatgacatttatcacacgtaattggatgagtacctttttcagcaccagagccgtcacaagtaggacaaacttcacttctagtataggtaatatcggtctttttacccttgattgcatccataaagtcaatcgtcattgtataatctaaatcttgacctttttgcggtgcagttggatctacacgacttctgcctccgccaaatgctgaaccaaagatatcaccgaaaatatcgccaaaatcaccaaagccttgagatgagtatccaccttggccgccaaaaccgccaaagccttgaccaccaaagccaccttgaccatttacacctgcttggccaaattggtcatactgagctcttttctgtttatcatggagaacctcatatgcttcatttacttccttgtatttttcttcagcaccaggttcatggtttaagtctgggtgatatttttttgctagtttacgatatgccttactaatctcactttcactagcatttttatcaacacccagcacatcataataatcacgttgtgccatctgaaaactcctttattcataaaagaaaagaactacaatcacgcagttcttttcttgtttgatttaattataaaactttttacttatcagggtctaccttatgaaagtctccatcaacagttgaaccaccttgaccgttgtctgagccattatcattgtttggttgaccaccattttgtgggccttgagggccagcttgaccagctgcaccttgagcaccaccattttgttggtaaagcttaacagctaaatcttgagcagcctttgataaagcctctttcttttctttcatttcatccaagttgttgtctttttgagccttcttcaaagcatctaaagcatcttgaacattcttagtttcagtttcaggaactttaccctcagtttcctttaaagtcttttcagtagtaaagattaattgatctacttcgttacgtaaatcaacttcttctttacgctttttatcttcttcagcatgctcttcagcatccttttgcatcttcttgatttcttcatctgataaaccagaagaactcttaatggtaatcttttgttccttaccagtacccatatccttagcagatacgtttacaataccgttcttatcgatatcaaaagtaacttgaatttgtggaacaccacgtggtgctggtggaatatcagttaattcaaagcgtcccaaagtcttgtcatcagcggccattggacgttcaccttgtaaaacatgaacatctactgctggttggttatcagctgcagttgaaaagatttggctctttgaagttggaatagtagtgtttctgtcaattaacttagtgaagacaccacccatagtttcaataccaagtgataatggagtaacatcaagtaaaacaatatccttaacatcacctgagataacaccaccttgaattgctgcacctaaagcaacagcttcatcagggttaattgagtggtcaggttcttttccagcccaatccttaacagccttttgaactgcagggatacgagttgaaccaccgttcaaaataactttatcaatatcatttacagtcaaacctgcatcacttaaagcattgtcaaatgctaccttagtcttttgaactaaatcatcagttaattcatcaaacttagcacgagttaaatcagcttcaaggtgaagtggaccagcctctccagcagaaatgaatggaagtgaaatgtgagttgaggaaacaccagataagtctttcttagccttttctgcagcatcctttaaacgttgtagtgccatcttatcgttagataagtcaacaccattttcttccttaaagttttggattaaccaatccataattctttggtcaaagtcgtcaccaccaaggtgagtatcaccattagttgataatacttggaagactccatcacctaattgcaagatagaaacatcgaaagtaccaccaccaaggtcgtatactaatactttttcatcattttcatctttatcaagaccatatgctaaagctgaagcagttggttcattgataattctttgaacatttaagccagcaattttaccagcatctttagtagcttgacgttgtgcatcgttgaaataagcaggaacagtaataactgcgtcagttaccttttcacccaaatagtcttcagaaaacttcttaatgtattgcaaaataaaagctgaaatttcttgtggagtatattccttatctccaactttaactttgtagccttcttcacccatatgactcttgattgaaacaatagtgttagggttagtgattgcttgacgcttagctacttctccaacttgaatttcaccatttttaaaagcaactacagaaggagttgtacggttaccttctgggttagtaataattttaggttctttaccttcaagtacggcaacagcagagttagtcgtacctaagtcaataccaataacttttgacatatatggaacttcctttcttattgagccactacaaccatcgctggtcttaatgttctatctttatattgatatcctttttgtaaaactttaactacgcgatcttttcgttcatcattttctgctgccacagtttgaacagcttgatgaagagaaggatcaaaagtttcgccctcggctttaatttcagtaattccttgatctttcattgatttaactaatgaatcaagagtcatctgaacgcccttttgaagttgcttagcagcttcatcatcggctttaacagctaatgctcgctctaagttatccattgcaggcaaaacttctttagccaagctttgagattcatattttattaactgagcacgttcttttgcatagcgcgcttgcatattttgaatctcagcttcactacgtaagtatttatcttcaagatccttatttttagcagttaattcagcaatttctttttcataattctctactggattttccttaacttcctctttcggagctgcttttggatctttttttggtgccttatctggggtcacctcgtcctttaaatctttttcatgcggaaactcttctttactcacagctaacctccttacttaaatctaccataataatctaacaatttctttgctagttcattcctaaaatactcgagtaatccgatcatctgcgagtatggcatgtttgttggccctagtagtgcaattgttcctttaccatatttaccaacactatattgtgcagttaataagctgtaattttcaagtaaatcggatggtaattctgaacccaatttaacctgaaccttagaactagaatcatttttcagttcatcttcaggattaaaaccaatcaaacttgaaagtgcatcattttgatcaattaacttatacagtgattttatcttggttaaatcatcgttttcataattactcaaaagattaatttgaccatcaacatacatttgctcactagccgcatctttaatgacatcttgtaagagatctaatatttccggtgcagatcctcgagcaataagatgatcagcaattcgcttgagtaatacttcattaattgaactaagtgattttccaactaattgatcattaatcaatcgaacagctttttcaatttcttccccgttagtgtgatgaggcaaagtataaatttgattctttacattaccatcatcagtgactaaaatggccatcacttgatgactagatagaggaacaattctaaaacccgtaacttttaccgaatgggtttcaggtcctgctgcaaaagctgtatagttagtcaaatcagataaaatctttgcagcttcctgcacaatttcattaacttgttgaaagggtcggtctaactggtaaacaatttgattatagacagacgttggtatttttactggattaattaaatgatccaaatagtatcgatagccagcagtagaaggaattcgtccacttgaagagtgtgtcttttcaagtagccctttctcttccagaaccgccatttcatttcgaaccgttgcactggagaccttgacaggcagttgattcatcacggtcttggaacctactggctcatgtgtctgagtaaagtccataataatagtctttaaaataagttcttgccgttcagtcaacattttctcgcccccatcattagcactcttctttcttctgtgctaacaatttatatgataccatactttagcaattgttcaagtagagtgctaaatcaatttgatttttaacaaaaaaagcaagtacttagtacttgctcaaatttatttaatcggtagtctgattacagttcttacacgatctactctagttcttcgcggatcacttaaatatatttcatgatgatagcgtggattttttatatcaatttgataattttctgacttaacaaatttatgcatattttcaattgtcgtcggttcgtcatcataactaccaatatgcatttgctggacacatagtccttcgttatatttaaaaaattttactttcgagaaatcttttttcttcttttcactagcagttttaactgcctaatccaactctttaggggtaacaaagtcgggtaaacgaatcattgaaatccaagaaaagttttctttatgagagtagtcgatttttgaatcatccctcatccaccagagaccttcaagaggtggaacaacaaaatcaaaataacctaggattttgtgttctccttttttactcattttaatggtataagcgacactatacagcatttctagagcatttttatatgttccatcttctttatttggatccccgcttcctgaaactgctagatagttcatttcaggaatagttattaattcaggtttcttttttggaaaatataaatctttatattcttttttatagtcaaataccaattttttctcctttaattatttagcttttacatctcctaattttattcgtttatctgtaacctgactaataaaatacttatcatgttcaattaatagcattgccggttgttcttttcttaacatgttaattaactgatcctggttaaacacatctaaataattagctggctcatcccataaatatatatctgcttcttctaccaatgatttggcaatcgccactcttttttgctgtcccatactcatttcttcaatttttgtggcaaagctttctctcggaaaacccatttttctaagaatatttaatagattttcataagatattttttctttttctgcaaactgagataaagtaccagaatattcaataaaattttgtggtaaatatgatatctttaagccattaacaatatcaagttttccttgagaaatcacatttttatctggttttaaaatatttttcaaaaatgtagactttccagatccattttttccttctatagctacaatcccatgatttttaatagttaaatttaaatcttcaaacaatttcttattttggactgtaagatctaaatgctgcgcttctaatagagttccatgatagttgggatgaaagttcatttctaattcaggaatagactcaatatttgtcattaagccttttttatcttgaatactcttatccattcttctttcaagattcttcgatcttttcattattttagctgctttatgactaaagaatcccttattaatgaatgcatggatttcatttttatgagcgcttgcttttttattgttttctgattgaagagaatatccttttactcgctttctactttcgttcaaacttctaatttgaccttgaagtttttcattcttatcttgattaaatttatctcgctttgtctttgtatcttcataactggcaaaattgccctgatacaaatgaatttcggtattttcaatggctaagatatgatttgttacttgatttaagaaagcacgatcgtgactcaccacaatgtagccattagaatgttgttgtaaataagctataacctgcattctggaatcttcatctaaatgattagttggctcatcgattaaaggaaaaccatttttattaataaaggatagtgccaacaaaatcttagtttgttctccaccacttaaagaattaaaaggctgccaaataagttcaggatcaactttcattaaatttaattcgcgttcaagttcccactgttcaaatgaaacctgttcttgtagcgcatataaagctaattgttttttatcattaacagtaagtggaaaatagttaaattcaagtttagcttgtatcttccctgttccccttaaattacctcgtaaaagattcaagaaggttgtctttccccttccgtttcttcctactaaacctaatttccaactactatccaagtctaaatttaaattattaaatatattatctgagctatcttgatatctaaaagaaagatttgaaatattaatattactcatattaatcacctcacgaaaaaagcctacacttttgacaagtgtagactttctcctagttaagcaaaaaaagaagattcccatctacgtttaatcttgtcaaaagtgcacagttgtccttataaaagaaaaataattattaaaattcaactatgctattttgcaagattaaaaacgcaacggcgtaaccttctttcaaatattaaatttcaattgatagaaatattctatcacatagattatataaaagtaaccctaaaattagtttttcaatttataaaaatattgtttaatatcacgcttatcctgatctaattgatgtgaaagttcttctataccagaaaactttttatttttacggataaacttgtaccaggctaaagttagtggcttaccataggcttcttcatcaaaatcaaaaatattagtttcaattgtcaaaccatgatttgttttgaaagtttcattatagccaacgctagtcatagcatcatgccattttccatttacctttgctctagttgcataaactccctcagctggtaaaactttagagccagaaatttcaagattagcagttggaaagccaattttatgtccacgtctgaagccgtgaacaataatgccagaagtttcataaggctggccaagtaactcagctgctagttcaacatttccatgctgaatagcttttctaatataagtagatcccacttttattttatctattgcttgttttggctccaccacaattttaaatctatctttagcaaatttaggtagattttctacattagcaatatctttggggccataagtataatcaaaaccaacgactactgtatcagctttgagtttcattaccacctgatcaacaaaatcttgaggcgaaagctggctaaattctttagtaaatttaataattactaagtaatctactcccagcttctccattttacgctctttttcttgctcagtttctaaatagacaaatttatgatcgtttttataaatttctttaggatgtttatcaaaagtcattaccattaatggtaagtgcttttgttctgctattagcttagcatctttaatgagtttttgatgtccaatatgcaccccatcaaaaaaacctagcgttaagattacctttttagtcgtgataggtgcagaaataggataatctaaggttattactttcattttttactctcactattcattttttaaaagcatcatttcaggacgataaattttaccttgtcgttgataaatagcttttatatgtccattataaaccaaagctaccttggcataagtggtattcaatttaatgcttgctccatttgaaactcttttaaattgatctggtgatatttgaagttggggtaaatctacgaaaaagctatcaattggttgaagccatttttcaggataatctatttctttttcaatagtttctagatctaccgcttgacttaaatcaaaacctgaactgctagttctagtaagactggtcattacagctggaactcccaattcctctcccaaatcatttactagggatcgtacataggttcctttagaacagcgaatagcaaaattaaaactttcagttttttctagtggatcatattctggatcttgagttaattcataactataaatgtttacttttcttttcggacgttctactgggatattttctcgagcatattcataaagtcttttaccattaacacggaccgcagaatatattggaggaacttgatcaatctttccagtaagttttttcattccactaataatttcatcacttgtaaatggagtaactatcttttcttctgcagtggttgttccatctaaatcatagctatcggttgctttaccaaacattccacttccaatatatgactttggtttttcatgcatcaattcaattagctttgtggcttggccaattgcaatcggtaataccccatttacttctggatccagtgtacctgcatgtccaatttttctaatttgtaaaatttttcgtaatttataaacacagtcactactggttactccgcgtggcttatttactactacaattccatttagcattatttaatctccaaaataaaagacgcctttcggcgtctctttcatttatttatttttattctcgcgttcttgatcttgcttcttgacttgattaattaacttatcaatcttagaaccataagcaacagaagtatcacgtttaaaaatcaactcaggaaccttgtaaacagttaaagtttgaccaagcaagtgacgcatcataccttttgctttatcaagtccttcagctacttctttttcctttgctggatcatctgtcaacatactgtagtaaacagtcgcatatgataaatcatttgtacattctacagctgtgatagtgacatcatttaaacgtggatcacgaatatctttacgtaatatctttgtcaattcacgtaaaatttcgccttctacacgaccaattctatgtttcataattaagctcctttttgtgaaaaaagatgcctatttaacaggtacctcttgcatctcgtaggcctcaagttgatcgtcaactttaatgtcattaaagttttcaattgtgataccacaatcaaatccttgcttaacttccttaacgtcatccttgaaacgctttagagatgcaacttttccatcatatttaacaataccatcacgaattacacgaatacctgaatctctagtaacatatccgttatcaacaaaggcaccagcaattgtaccaatcttagataccttccaagtttcacgaacagttaagttaccagtaactttttcttcgtatgtaggttcaagcatacccttcattgcagcttctacatcatccataaccttgtaaataatgttatatagacgaatatctacaccttcagaatctgcttgactcttagcagtattagttggtcgaacattgaaaccgacaataaatgcatttgaagcaccagctaaagtaacatcagattcattaatggcaccaacaccagagtgaataatgttaactcttacaccttcaacttcgatcttttcaagagattgttgcaatgcttctgctgaaccttgaacgtcagccttaagaacaatgtcaacttccttcatgttctctttcttcattgtatcaaacaagttgtctaaagtaacatgttggacattttcacgttgtttttctaaggcattcttagcacgttgttcaccaacgcttctagcagtcttttcatcatcaaagacaactaatttatcagctgcttctggaacatcatttaaaccggtaatttctacaggagtagatggggtagccttcttcactctacgtcccttatcattagtcataacacgaacacggccaaatgtatcaccaacaacaattggatctccaacctttaatgtaccttgttgaactaaaatatctgctactgaaccacggcccttatcaagacgagcttcaattacagtaccaattgctttttgatctggatcagccttaagttccatgacatcagcttgaagtaaaatcatttgcaagagctcttcaacatttttaccagtcttagcagagatcttaacaaagattgtatcgccaccccaatcttcaggaactaaaccatatttcataagttgttccataacatgatcaggatttgcgcctggcttatcaatcttgttcacagcaacaataatcggaaccccagcactcttagcatggtcaatagcttcaattgtttgtggcattacaccatcatcagctgcaactactaagataacgatatcggtaatttcagcaccacgggcacgcatatttgagaaagcggcatgtcctggagtatctaagaaagtaattaaacgatcatcgattcttacttgataagcaccgattctctgagtaataccaccggcttcgtgttcagacacgttagtgtgacgcaatctatcaagtaaagtagtcttaccgtggtcaacgtgacccataattgttacaactggtggacgtttttcttgatgcttagaagctttagattcttccatttccttagtgtataaagtatcaatatcagagatatcttcatgcactttttcttcagcttcaataccatattcagctgctaaaagctcaatagtatccttatctaaagattggttttggttagtcataacacctaacataaatagcttcttaacaatttctgcaggctctctatgaagaagttttcctaaatcttgagcattcatgccttcttcataaactaatgtttctggcaatggacgttcctttctttgagttggttgcttcttgacttctttactttggttgatacgtttattctttttatttctacgacgacgtgccttatctgaatgttcgcttctttcacgttcataatctggcacttcacgtttcttacgagtaaagtctttcttacgagttggctttgtttcttctttttgaggagcaggtacaactggagcgataggctctaccttttttacagtaggtctcttagccttatttctagccggcgatggtttaataatctttggaccaactggtttttgtgaagcttgaacacgagcttttacagctgcagctccttcgagtttttcttcttttggcttacgagtattttccacttttttaacctttgatctttgaggattttgttcttgatgccatttacggcgggaagcctcagtctgagcgtttaattcactagcttcggctctttgttttttcttaaatttatttaataaatcacgtgctgctggtttagcagaagttgtctttttatcttcattctcacgtcgattattttgttgttttttaaaattattatttctgtgcttgttatttccgtgacgattatcatgttcatttttattatcacgacgacgaattgcacccacagaaacctttattttagctttttctttacgacttgaatttttagaatccttttcagtagatggcgtagtattagtagacttcaaactatctactaacttagaaacttgcttatcatctagggaggacatgtggctctttacatcaaaacccaaatcttgtgccttttttacaacaattttgttttcaatgtctaattctttcgctacttcataaatacgttttttagccatcaaatcacactccttcgtttaaattctttatcattgctttgctgaaaccggaatccgtaacagaaactaattttctttcttttccaagggcctgtgttatttcagcactagaaaaagtgtctactagtttgacatctttttttcttataaggaaattcagtttatctttagtattttgacttacatcattcccaataaaaatcaattttgcttgatttttgcttaaagatatttttactgcatcaaatcccgttgctaactttccagctttttgcgctaatccaagtaaatttaaagttttttgtttgttttgcaaaattacttatcaccaaacaattcttttcttgctttttgatgatcaacatatgcataaagatcatcataaaaatcagctgaaactttaacccctaagcttttttccaaaacttgatttttttgtgcttcagcaattttatcaggttctaaagatacatatgcacctctgcctgatttctttccagtcggatcaaccgaaatatttttatccttatcaacaactactcgcaccaattctttttttggttgcatagtatttgttaacaagtctttacgcattggaatttttcttttcttcaaagaaagtcacctattcctcatctttatctgcatcatcatttaatgctgaattaacgtcttctccatttggaaacttatcacttggctcgtcttcaatttgttcagcaatagattctggtgtttcttcatttgagacattatcatttgtagtctcttgatctgcttcaacatcatcaccttcagaatcaacaaattcaacttgtgattcaggtttaatgtcaatcttatagccagttaagcgagcagcaaggcgtacattttgaccacgtttaccaatggccaatgacaattggtaatcaggtacaattaccaaagcattcttatcatcttcatccccgctaaattgaactgcaattacttctgctggattcaaagcattggcaataaaatcagatggattatcttcatattttacaacatcaatattttctccacccaattcattaacgatgttttgaacacgagctccctttggtcctactaaggtaccgactggatcaatatcagaatcattactcttaactgcaatcttggttctatcgcctgcttcacgagcaatggatacaatctcaacagttccatcgtaaacttctggtacttcttgttcaaaaagacgttttactaaatcaggtgctgttctagaaactgtaatttgtgctccctttgaatcagaccctactctagtaaccaagacacgaactttatcttgaggattgtaagtttcacctggtagttgatcattatgcggcattacagcctctacatttccaatcttcacataaacgaagcgattgtcacgtctttcaactgtaccagtaacaatttcatctttatattgagagtactcgctaataatatgttctctttcagcttcgcgtaaacgttgcataataacttgcttagcagtttgagcagctaaacgtccgaagtctttaggagttacttcaaaacgaatttcgtcaccaacttcgtaagcacggttaatttcaagagcatctttcaaacttacttcgagacgactatcttgaacttcatcaactacagtcttaattgcattaactttgaagttgcctttcttttcatcaaaaacaacttctacattttgagcttggttataatttttcttatatgcagctactaaagcagccttaattgcatcaacaataacttcttgtttaatgcctttttctttttctaaggttgcaaaggcttccaccatttctttagacataagtttttgatcatcctttctaaaattcaactgcaaagcgactagaagcaatcacctttctagggattgtgatgtctttgcgtcgtgttttgatctttacttctaagacgatctgatcttgattgagatcttttaaagtaccttcaaaagtcttttcaccatcaattttttgataaagactaacatgaatgtaggatcccttggcacgttcccaatctttttcattcttaattggacgttctaaaccaggagatgaaagctctaaaatatacggttcgggaaaaggatcaggatctaattcatctagtttttctgataccaattcacttaaatttgcgatctcttcaatatcaattccgcctgggcgacgatcaacataaatgcgaagataatattgcttcttttcctttacatattcaacatcgaccagttcatcgcctcttgcttcggctaaaggcgtaactacgtctgccaccaattcggtaacttttgtcaaatctcttcctccgtaataaaaagagtgagcattactgctcactcgaatttgctattcgaacttcgtttttagaatagcatatttactgcaatttgtaaattatcccgctaaaatagtgacaattgattctgatcaggcattccctcaagaacaccattattttcaaaatactccataattgtttgtgatactttgccgcgagtggcaagatcttcttttgaaagaaatttctgttccgcacgtgcagctacaatttgctttgcagcattgtcacctaacccaggaacagcattaaatggtgctaagattgtatggtcatcaataatcttaaagtctgtggcttcagattcgtttacatctaccatcttaatctttattccacgctctaaacattcatttgcaatttcaagtacagtaagtaatgacttgtcttttgcagaaacatccattcccttatcctgaatttctttcattgcagctttaactgtattcttgccgtgactcattgctaccaaatcaaacaagtcagcacgaacagagaagtaagaagcataataaattactggataatatactttaaaccaagcaattctcagtgccatcaggatataggctgtagcatgggctttagggaacatatacttaatcttaagacatgagggaatgtaccaatcaggaatcttatcgttctttttcaagatttccatattttcatcgctaattcctctaccatgtcgtacagattccattgtaaagaaagcaacttctggttttacaccccagtgaatcaagtccatcatgatgttatcacgacaaccaatcacattcttcaacttacaagtcccattattaattaagtcttctgcatttcctaaccatacatcagtaccgtgcgataagccagaaatttgcaataattctgagaaagtagttggttttgtttcttcaagcatccctctaacaaactttgtaccgaattctggtacaccaagtgttcccgtttttgattggatttgttcagaggtaacacctaaaatttcaggacttgagaagagagacattactcccggatcatcaggaggaatagttaatggatcaactccggatagatcctgtagcattctgatcatggtaggatcatcgtgacccagaatatcaaattttaaaatattatcatggatagaatggaaatcaaagtgagttgtaagccaagctgcacttaaatcatctgctggatactggactggagtaaagtcataaatatccatatcatcgggcactacaacaatacctgctgggtgttgtccagttgttctttttactccagaagcaccggctgctagacgatcaagctcagcctttcttaaatgtagttcattttcatcttcataatgcttaacatacccataagcagtcttatcagcaacagtcgcaatcgtccccgctctaaatgaattgtctggaccaaacataactcgaatgtagttatgagctactggttgatagtctccagagaagtttaaatcgatatccggcaccttgtctccatggaatcctaagaaagtagcaaacggaatatcttgcccatctttaactaatggagttccacattttggacactctttgtcaggtaaatcatatcctgacccatattctccattctcaaagaattttgaatacttgcaattcggacaacgatagtgcggagccaaaggatttacttccgtaattccagacatcgtcgctactaaactagaaccaactgacccacgtgaccctactaaatatccgtctttatttgatttggcaacaagcctttgagaaattaagtaaataactgcatatccgtttgaaataatagaattcaattcaagttcaattctatcttctacaatctttggtaaaggttttccgtataattcgtaggctttattataggttaaatccttcatttcttgatccgcattttcaatatgaggtggatatagtccacttttaatcggagcaatttcctcaatttgatcggctaatttattggtattatcaattacaatttctttagctacatcttcacccaaaaagctaaatgcatcaagcatttcctgcgttgaataaaaatgtaaatccggtaaattcttattgcgattagaatttcccttttgagccgctaataaaattttacgataaattgcttcatgcggttcaacatagtgcgagtcactggtagctacgactggtttatttaattctttacctaatttataaatattttgaataatttcatgcagctcgtcttcatctttaattagatcatcttcaattaaggtttgataagctgctggcggttggacttcaagataatcataaaaacgtgctttttcacgagcttcatcatatcctttttgcatcattgaaatgaatacatcgccttgccagcacccactaccaaataataaacctttatgatattttcttaattccgactttggggtacgtggaatacgatagaaatatttagtacttgcaagcgatacaagcttgtacatattttttagtccttcttgatttaaagcaagaacactcatatgacttggcttagctcgcttataaacttgaccatatttagcatagtcattcattttgcctaaatctgcttcatgaaaacgttcattaaaagcatctagcaatttaaacattaagtatcctgtagcttcggcatcttgattagcgcggtgatgatgttcaagaacaacattgtacttcttagctaaagaatcaagggtgtggcgagtttgttcaggatgcaaaagtcttgaaacttcaagcgtgtcaacaacaggttgcgtaatttcttctagacctgcacggcgtaaagccgcatttacaaacccaacatcaaattgaacattatgtccacagagaggacgatcaccataaaattctttaaatttcttaattacatctttttcatcatcagctgcaccaaccatttcatcagtaattgatgttaagttaatcgttgtatcgctcaagggatgatgtggattgataaattcatcgaatctttctaggacctcaccatttttcatttttaccgcaccaatttcaataatggtgtcataaacagaagatagtcctgttgtttcaacgtcaaaaatcacatattctcgattccgataatccatttccgtaggattaagaacaagcaaagcatgatcatcaatcatattggcctcatagccgtataaaattttcattttttcgcttgcaccagtatgataagcttccgggaaagattgcacatctgcatgatccgtaattgcaattgccttttgaccaaattttttcgcagttttgataaagtcactcgccgtactagttgcgtccaattgactcatatttgtatgaaggtgcaattctacacgctttttctctccttcatacttttcttctcgacccttatgttcaattaattctaagtttcgaatattaaaaacaacgtcatgttgatattgatcatcagctgcataaccttgcattctagcccaaacgccaggtttaattccctttagataatcaatttgatctttgtcagaaacaaattttttaaagctaattgaatctgtatagtcagtaatctcaccagtaaaaattacacttccagattttaattcatgaatatccgtgttaaaaatatgtccttcaatagctacgtttccactgccatcttccaagtctttaatttgaataaatttagcttttttatcgacctttttgttgcccattcttgtactcttaacaggcatttttttcttaggttctgccggttgtttttcatagaattcttgcatagcagactcatgctgagcctgctcttgttctagacttcttaaattttcatcaatattagtttcatcaactttcgttgtaaacttgatattaaagaaaccataacgtctgaattctttatttagttctgctaaaacttgttctgaaagcaagccatttactacttggttttgagtgggaattagccatttttctttttctaaataaggagcttgtccttgtaaaaattcccgaaccgctggttttaggttagttgaattctgaatggcataagtccagtaggccggtagttttttactacttccatcgcgtgtttgaactaataattcaacattcacaaatggttcaaaagtctcatgaataagttcattaagagagcgataagtttcaaaatctaatggtgtatcaaaaaaaacgtggattttccactttctttcattagcgtatacatccacgttttcaatttcaccattttggacaatatcgttatcttcaaacttatcaggaaacttgatttgatctaatagttttttgaaaagttcgttcttttttgtcacaaaaattatcctaactcttttgtaatcacagcatccaaatcagaaatattaacttcagtagccttttcatccattggacgctttacttctacaataccatcttttgcttttcgaccgattgtaattcttaatggtgctccgactaagtcagcatcattaaatttaacacctggtcgttcatttctatcatcgtataaaacatcatacttggctgaaagttctttttcaagtttttcagctaatttagtttgagtttcatccttcattttcatttgaattaaatgaatggcaaatggagcaatttcttttggccatgcgattccattttcagttaagtgttgttcaactgcagctgacagcattctggttaccccaattccataggagcccatgattactggcttagctttaccattattatctaagaaatcagcacccatagtatcagtatagtaagtacctaatttaaagatatgaccaacttcaatactagtagtaaatttcaatggtaaatgatcaactggatctggttctccttcgtttgccgtacgaatatccgcaaattcgtcaactttaaagtcgcgatctaaattagcattttgatattgatagtcggtttcatttgcacctacaactacattgtacaaatctttgactgtttcatccgcaataatcttatcagcccagtcagcattgattggtccaacgccgcccttttctgaaccagtaatttctactaattcatcagcatttgcagttctaacttcatctgcatctaagatatgacctaatttaacttcgttaatttccttatcaccacggatgagaactaagaccttttggtcatctgcaatgtataagatactcttaacaattctagttgaaggaactttaagaaaatcagctaacttttcaattgtatccattcctggagtggctactttagctaagtcttttgcttcttctggttcttgtttaaaagtatcaatacttttagccatttcaaggttagcagcgtaagtgcctttttcattagtagcaattgtatcttcaccaattgcagcaggagcttgaaattcagttgagttctttccacccattgtacctgaatctgcaataacagggtgaacagtaacaccagcacgattaaagatctttaaatatgcggatttttgatcatcgaattgttcatctaattgttcacgagttgctgcaaagctgtagccatctaacatgacaaattctctaccacggagcaaaccgaaacgtggacgattttcatcacggaatttagtttgaatttgatatagagcaagtggcatttgcttgtaactctttaagttcttagcaacaatttcggtgaaggtttcctcatgtgttggtccaagcaaactttcacgtccatgtcggtcttgaagcttaaacatttctgcgccatattttttataacgaccagattcttgccaaagggttgcaggcaagagatgaggcatgatcatttcaggtacattaatattatccatttcttcttcaataatattttccgccttgcgtaggacgcggtaacccaaaggtaagtatgcataaaccccggcagttacttgacggatatagccacctctaagcattaattggtgactttttgctacagcatcagaaggtgcctcttttaacgttggcataaaaaattttgattgacgcatttattcctccaaaaatttacttaataaaatagcgataaatatcatttccagttactgcaacaattaacagtaagagaatgacaaaaccgattacatctataattgcttccttatcttcaggaattggttttcgaataatgagctgaatcaggttaagtaataattttccaccatctaatccagggattggaatcaaatttacaattcccaaattaatagaaatcattgctaaaaatgctagcaagtatgtaaagcccatgtttgaaacttgaacggtttgcgaataaattcctaccggtccagaaagcttgttcaaactaaaatgtctaaacaaattacctacagcattaaagattaaaccagttgtactaatacttgtattccatccacggctaatttttgcaccaagactattatcaggctttccataaaaaccaagttgatagactttttgaccatctatcttattagctttaggctttatggagaaatttttaaccttattatctctttttacctttacttcaacagtcttacctttactttcagctagttcagcagcaatttgattgaaattactaatttttttattattaatcgcgataatttcatcattagctttgatcccagctacttgagcaggttgatgagcaatagtgctacctactgttgtagtcggtgcaccaggagctgctaatgaccaaataataaatacaacaaatcctaagacaatattcatgaatggaccagcaaaattagtagctagttttttaccaacactagcctcttgaaattgtgtatctcggggtgcaattaacaattcagttccattttgctcaatgatcgtggcatcatgatcaacagaataagtttttagctgatcttcatcaccattttcatatccttgaatagttaatgcatctactaaatcagcggcattgacttgtactggaattccttcaattggcatttgagatcctgatgcatcaattcgtttaactttattttgatcatctaactgcaatactactgtagtaccaggatcaatctttgcggcatcatcaggtcccgctaagcgcacatatccccctaaaggaagccatctaatagtatatgtggttttagcacgcatcttttgaaacaattttggccccataccaattgaaaattcacgaactaaaataccgcacttttttgcaacaataaaatgtccaaattcatgaacaaaaacaagtatcccaaaaacaactagaaagattaaaatacctttcattcagtagctctcctataaaatacccataaatgcaacaacaggtaaaacgaaaagcatgctatcaaatcgatctaaaattcctccatgaccaggcaagattttacctgaatctttcacaccataaaagcgtttataagctgattcaactaaatctcccatctgaccaacaattgataagaagaaggctagaacaatcatcatagcattattcctaccagtaggaactaaggtaacataaattgctgcgataattactgcacaaattactgctccaatagatccttcccatgttttattaggactaataactggccataatttatgctttccaatcttacgtcccaccatatacgctgcaatatccgttgaccaaacaactgcaaatacatagcctaaaattgctaatccaagatgggcatttctaatagcggccatgaagtgaaagccagttccgatgtataaggcagccaaagtataaactccggcatcatcaaatgtaaccttattcttagacaaaaccgttcttacgagcatcaacattacgaagatataaaaaatatcatacttatttaaaaacgcaggtaaaaatttaaagaatgaatcggggactgccatagtcaaggttgctaataaggccaagataaaatcccaagaaacaataatttgcttcttcataataaaaatttcgctaattccaactgctgcaaacgcacaaactaggacatcaatccaaatgccgcccattaaaacaatcggaataaataaaattaaagctacaatagctgttattacacgttgtttcatttaaaattctacagttctaattaaaattatacttttccaaaacgacgattacgtccttgataatctttaactaattcttctaaatcagttttatcaaaatctggccataatttatctgaaaaactaaattcagtataggccatttgccacaataagaaatttgataaacgttcttctccagatgttctaattaataaatcaggatcttcatatggagctaaagaatgagtcagcaaatgatctgagaccattttttcactaatatcatcaatatcaatttccccgacttttaccttacgagcaatttcttgtactccagccgttatttctctacgcgatccatagttaaaggcaaaattcaataccattcctgtattattagctgtttctgccatggctttttgggttactaaatatgtcttctcaggtaattcgtctacaaatcccatgatattaacccgaacgttattttccattagttccggcataaacttatcaaaaaagtcaattggtaaacgcatcaaatagtttacttcgtcagtcggacgagcccaattttcagttgaaaaagcataaagtgttaaaacttttattcctaatttattggcggcaagagcaatatttcgaatattatccataccatgacgatgtccgacaaaacgtggtaaatgtcttttttttgcccatctaccatttccatccataattatggctaaatgattaagtggtttttttgattctgacatatcttatcaagtcctaaactaaccctgagtaatttcttgactcttttgatctgctaatttatcaatttctttagtagcatcgtcagttactttttgaacttgtttttctaaactacgttgttcatcttcagtaatatcgccatctttttcttgacgcttcaaagtatccattgcatctcgacgaacattgcggacagcaatcttacctttttcagcaagcttgcctacttgcttagcaatttcttgacgacgttcaccagttaattgcggaataacaattctaattacagtaccatcattagctggagtaattccaagatcagaagctaagatagcatgttcaatgtcatctaaagttgatttatcataaggcgttaccattaaaacacgagcttcaggaatacttacactagacatttgtgtaagtggagttggaacaccgtagtagttaaccttaattccatccaataagcttgcatttgcaacgccggcacgaataccacctaattccttttggaatacagcgatagactttttcatattatcttttgctttttcaattacttcattagccattatttatcacctttgattacagtaccaatattttcacccataacaactttcttgatgttaccaggcttatttacattaaagacaactagtggaatattattatccatagacaatgaactagctgtactatccattacttttaagttctttgaaatcaaatcaagttgagttaattcagagtatttcttagcatttggatcaactttaggatcagctgagtaaacgccgtcaactccatttttagccatcaaaattacatctgcattaatttcagctgctcttaaagctgcagtagtatcggttgagaagtaaggattaccggtaccaccaccaaaaataacaacacggcccttttctaaatgacgaacggctttacgacgaatataaggttctgcaatttgacgcatttcaattgatgtttgtactcgtgttggaacgcccaagttttctaatccatcttgtaatgctagaccattcataattgttgctaacattcccatgtagtctgcctgagctctttccatacccagatttgcaccagtttcaccacgccacatgtttccaccgccacacacaatgccgatttcaacacccatatcgtgaacagacttaatttcttcagctagatgcttaataacctctgggttaataccagtacctttttcaccagcaagggcctcaccagaaacttttaaaataatacgtttatacttaacttgactcataaatttacctcctcattgcttttatcattttaccataaaatcactgcaatatattataccgaaaaaaaggagcaacgcctaagcgttactcccatttttaagtaaataattacttcatttgttcacgtacctcggcagcaaagtcttcttgcttcttttcaataccttcgccaacttcgtaacgttggaaagcaactaacttagctcccttttccttcaagaattcgccaacagtcttgctgtcgtccataatgtagttttgtgataaaactgcaaattgcttatcaacttgagtattatcatcaataaagcgttgcatcttaccaggaataatcttatcccaaatcttttcaggcttaccttcttctttaagttcagccttaatgtcttctttagctttagctaaaacatcatcgcttaattgtttttctgaaccataaacaaggtgtggtaatggcttcttgtttaccaaagcacgactttcgttatcttgatcaatcttgtggttcataacagctaattgatcagtgatgaattcatcatctaattcatcaggtgagataactttaggactcatagcagcaatgtgcatagctaaatgcttagcagtagctgcatcagcaccttctaaaacagtgataacaccaatttggccaccattgtgttggtatgcaccaaattcttggtcatcagttttttcttctaaagcgaaacgacgtaagacgatcttttcaccaatagtagcagttgcatctacgaatgactgacccaaagtagtaccatcagccatctttaattcttcagctgcttccatgtcagcaggtttaccttcagcaatagttttagtagcttcattaactaatttaacaaacttatcgtttgaagaaacgaagtcagtttctgagttaacttcagtaatagctgcaacattaccatcaacgtaaacgccagttaaaccttcagctgcaacacggtcagctttcttagcagcctttgccatacctttatcacgaaggtattgaactgccttatccatgtcaccgtcaacttctactaatgctttcttggcatccataacaccagcaccagtacgttcacgtaattctttaactaattgagcagtaatttttgccattaatatgtcctcctacagaactaacagtaaaaacaaattagtcttctgatttttcaacaactacttcgatggattcttcttcatcgtcttcagctgctgctttatcagccatttctttttcaacatcttcgctgtcatcttggccttgcttaccttcgataattgcatcagccatagcacctgaaatcaaacgaattgcacgaattgcgtcatcgtttgctggaataacaacgtcgattggatctggatcagtgttagtatcaaccatagctactacagggatacctaaaatgtttgcttcgtgaacagcgatcttttctttcttaggatcaacaacaaacataacatctgggattcttggcatatcttcaataccacctaagaatctttcaagtttttccatttccttagtcaaaagtgcaacttccttctttggtaatacgtcgaaagtgccatcttctgacatttgctttaattcctttaatctcttaacacggctttggatagtagtccagttagtcaaagtaccacctaaccaacgttggttaacgtagtattgacctgcacgtgtagcttcttctttaacagcgtcttgtgcttgtttcttagtaccaacaaacaagaatacgccaccgtcttgagcaactgccttaacgtagttgtaagcgtcatctaacatcttaatagtcttttgtaagtcaatgatgtagattccgtttctttgagtgaaaatgtaaggagccatctttggatcccatcttctagtttggtgaccaaagtggacacctgcttcaagcaattgcttcatagtaacaactgtcataaaaaattcctcctggttaattcctctcaagaggtcgtattaaattctgaccaataaatggcacctaggaatttaatcgctcttgatgtgatataaatttaatatgcgaaacgcatacttgaacattgtaactaattaattttataaatgcaattaaaattttacattatgttcttttaaaaactcttctttccattttcttgaatggtgtttgaaccaatattctctctttaaggccagttttttatcatcaagttcttcatgataaatcatttttactggtcgacgtgtttttgtgtatttagctccttttccttcattgtgcatctttaatcgatgagctaagtcatttgtaaaaccaccatagaaacttccatcattacacaataagcagtaaaaataatatttttcttttttaggcccttcttccttattttcagtgataactttttttatttcaggtgtaaacgatccatcttgattatgaacaacaattgcatccctcaaaactagaccatcactcgcagtatttctaattgcttctaccacaactaaattagcatctgcctctctcttagagacaaatggttgcacccactttacactcagttgattttctaaacaatagtgcataatttcacccaaacgctcaggccgatgaaccataaacattttgcctttcatcttcagcagatcacttgatactttaattatttgctcaaggttaattgctagttcatgtcttgctaaggcctttttttcatctggattaacaatatgacctttaggaactttgaaataaggaggattaacaacaactacatcatacttatctttacctaattttttcggggcatctaatgcattcagacaatggacttctatccgattttctaatttattcaatttaatacttcgtcttgcctgatcagctatttctttttgaatctccaccgcatcataatgtgcccggttaaaataggacaggtagatactagcagccccattaccactacataaatcaacaactttataattatcatgtattttattttgcgcaaaatatccaagaagaagcgtatctaaagaaaaagaaaacgcatctttttcttggatgatttgtaggtcatcattgtacatataatcaattcgttcattaggtttcaatagatccattttctatacccttctaaaaattctttgctgtattgtataatactatagataaaattggaggaaagattatgttttataaaattattcgcccaatcgcccgatttattgtctgggtacttaatggacatttacatgttcatcataaagaccgtataccaaaaggtaactatattttagtagcccctcatcgaacttggtgggaaccaattctttttgccttggctgcaagtccaatggaatttatgtttatggcaaaaaaagaactttttaaaaatcctattttgagatttattttagtgcatgcacatgctttttcagtagatcgcgataatcctggtccttctgcaattaaaattcctgttaaaggattacgcaaaggtgatctatcgttgattatttttccttccggaactcgtcattctgaagaacttaaaagtggcgcatttgttattgccaaaatggctaataagcctttagtgccagttgtttatcaaggaccgttgacctttaaaggcttcctaaaaagaaaatccttagacatttgttttggtgatccaatctatattccacgccgcgaaaagattaataaagaaactacacctgctctataccagcaattggaagaagcttgggacaagctagataaagaacaaaatcctgactttcactatatcgcaaaataatttttttattattcaagatttttagtgttaaaatgacatagtctagtgtagaaaaggagaatcgataatgttagaaaaacctttgtataaaatgatgcttagtcattcatttaatgtccctgtaaaagttacgtactgggatggaaaatcagaaatttatggaaatggcacaccggaagtggaggttatttttaacaaaaagattccttttaaagaaataacaagtaacgcctctttagctttaggtgaagcttatatggataaggaccttgaaattaagggtagtatccaaaaattaattgaagcagcatatgaaagtagtgaatcatttatgcgtgcttcaaaatttagaaaatttttacctaagcaaaagcatactgagaagcaaagtcaagaagatgttcaaagtcactatgatatcggtaacgatttttataaactatggcttgatccaactatgacttactcatgtgcttacttcactaatggtaataaagatgatcttgaagctgctcaaattgctaaagttcatcatattcttcaaaaattagatcctaaaccaggtaagactttattagatattgggtgtgggtggggaaccttaatgctaactgcagctaaagaatatggacttaaagttaccggagtcactttaagccaagaacaatttgatttagtcaaccaaaaaatcaaggacatgggtcttgaaaatcaagccgaagttttacttgaagattaccgtgaattaggtaatcgtgattttgattatgttacttctgtaggtatgtttgagcacgttggttcagaaaacctaggagaatacttcaaagacgttgctaaatacctaaagccacacggtgttgctttaattcatggtattactcgtcaacaaggcggggctaccaatgcctggattaacaaatatatcttcccaggtggctacatccctggcctagtagaaattgtctcaagaattgaagaagctaacttacaaattgctgacatggaaatgcttcgtcgccactatcaaagaactcttgaaatttgggataaaaactttaatgaccaccgtttagaggttgaaggaatgatgggcgaacgctttgtaagaatgtgggatatgtatcttcaagcttgtgcagcttcctttgaatcaggaaacattgatgttattcaatacctattaacaaagggcccatctggtaaaaccttaccaatgactcgtcaatacatgctgaatgataaataaaatataattcaaataaaagctcggtcttaaacgaccgagctttttatttatcgctattttgttgaagcttataaagattgtagtaataccctttcttcttcaatagttcctcatgtgtaccacgttcaacaattcttcctttatccaaaacaataatctggtccgcatctgcaattgttgaaagacggtgcgcaattgccaaagtcgttcttccttgacgaagcttctttaatccctcttgaattaaattttcggtttctgtatcgacattagccgttgcttcatctagaactaaaattttaggatcagttactaaggttcgtgcaaatgaaattaattgtcgttgtccttgactaagttctgatccaccttcaatcacttttgcatgatatttaccaggcatcttttcaataaatgaatctgcttgtacggttttagcagcatctttaatttgttgatctgtaattttgtcattatacaagcgaatatttgaagaaatgtccccatagaacataaagggttcttgtaaaactaatcctagttttttacgtaattctttctttggaaacttcctaatatcaatgccatcaataagtacttccccactaccaaattcataaaatctcatcattacattgataattgaactctttcctgatccagtatgaccaacaattcctaaagtttcacccggattaactacaaaagatacatcatgtaagatttcattctttccatcataagaaaagctgacatttttaaattcaatctttccttttgaaataactgctctttcatcattttcttgtcgcggttcgtattctttttcatccataattctaaaaatacgtttacctgccacaatcccatcctgaaaagaagtcattcgatccatcatagtagaaataggattaaaaaattgttgtacatattgagaaaaagcatatacaattccggcaggaacaaaagtctcttgcaatggaaaaccaaaatacattaacactaatgcaagagccaatgaataaagcaaactagtcattggcgagagcaaaagcgagttaactcggatcaagttaaaacgtgttctcattaaagtaccattctcattttcaaaatggtttgtcattcttttttcctgcttaaattgctgaattagagaaactccttcaatagattcatttaagttagtattaattcgactaagccgttccctaaaagcacgatacaatctagaactcttttgtgtataaatccagaaaataaaacctaaaattggtaaaaacagcaagacaattaacgccgcaaatttattggttacatacatcgctataaaagcagttactaaagaaaatactccaatgactacttgacaaagtactcctaaaaagtcgcttagagtcatcgtatcattagtgactcttgatacaattgaacctgctggggtctggtcaaaatagcgcatccctaaactatgaagttttcgatataaatcttttcttacactttcaagtgttttttcagcgccaagtgcatataaatattgatatacaaattgaagaattgccttaataattgttccaagtccatataatagtccagcccaaactataatctgtaccgttgctttttgtttgatcaaataattatctaagaaaaactgtagtccccttggtaaaagcatattaattacacttactaagaaagctccaaaaattgcaattcccattccactttaaaaggctttacgtactttaaaactcttttaaatatttgaacttgttctttaaatgggatggccttagaccaaactgatttgctttcttcattcttgtccatctacttcacccacctttgcttgtagttcttgtttacgccacatttcagcataccaaccattttgagctaaaaggtcagcatgttttcctctttcaacaatcttcccctcttttagaactaagatgagatctgcatccattacggaagtcaaacgatgggccgcaatcaaggtcttttttccttttctttccgatttaagtgaatccaaaatagaggtctctgtctttgcatccaccgctgaaagagcgtcatctaatatcaaaataggactttcttttaacaaggctcgtgcaattgacaatctttgtttttgtcccccagacaaagatactccattctcacctaccaatgttttatacccatttggcatttgcaaaatgtcatcgtgtaaatcactcttttgagctgcagattcaattttatccttctccacattttcatcagaaaaagcaatatttttttcaatggaggtagaaaacaagaaattattttgtggaacatacgaaatttcacttaaaagtaattttaaaggagtatttctaatatcatgaccacctaagcttattcttccttggtattgatcaaactctcttaataaaagctcaataatagtggtctttccggatccaacttttcccactaaacctaatgtttgtcctggttttaatgtaaaattaatattttgcaaaactggtatttctttttcatcaggataggcaaaggatttaatttcatattttaaatcaccttgaatatctcgagctgttaagctctgatcagcgttttcatcagtaatttgaggtttctcatataatagacgttcaacacgatcataggaggctgatccacgctctaaaatattaaataaataaccagttgcaaacatcggccataccatattagaaatataagcaataaaggaaaccaattgaccaactgataaagtatgatttgataccagtaacccaccatagataatcgtaattacataagttgctccaataattaatgtccctaatggatcaaacattgaatcccatttaaaaactttcttattgatttgaatggtatcatctaccatcttattaaaggcagctgaatcctgctcactttcaccaaaggcttttaatactttaattccggaaactgattcttgagttttattatttaaacgtgaaaatgcagcttgtgatttgtcaaaactataatgaagcttatctcctaacttccaagcacctaaagcaagaaaaggaagtggtaaaagggcaataatagttaacctaaaatcggtaaaaataatcattgcaatcattgtagttccaccagtaaccaaagagtcaactaaagtcaaaactccatctccagctacattttgaatggaattgatatcattagtcgcatgtgccattaaatccccggtgcggtgcctttgataaaaagttttatccattatcataaaatgcttgaataagcgggatcgcatttgtctttctaactctgctgctccaccccaaatttgcttacgccaaaagtagcgcaataaatataagactatagctgcagcaatgacagctaaaattaaggcactatactcaccccagctaattgaccctttatctagctggtcagccatcagtcccaaaattctaggtgggactaaattggcaattgaagttaaagctaaaaaactaataccaataatatatcttttcttctcttgcttaaaaaaccatcctaatttgctaaaaatattcatttttcaccccaccatatacaaaaagacagaggaatacgatcctctgtctattaccaaatattagtaaaggaagctactatttttgttgttgatgcttcatcatattcataacttgattaagcttcttagcagatggtttttgtcccatttgcgccatcatagctgcaatcatatcttcactaataggaggattgtcttggaaatacttcttcatgtatgcgcgagcaccataaaatccgccaacaagaccgattaataatgcgataataataagaaaaattgctaaacctaaattcatttcccaaaaacctccaaaaattaatgtactttttcagcataccaaaaaaatagtattttttaaagtaaaatattaatcttttcttaatcctttacgacgttgtgcctctttagctttttctgaggttacttctttaccatctttgtcaatgactacagtatcctctaattgttgtctaaatccagcacggaagttttctagaaaagcagatcttaattttttacgttcctctaactcatcaggagttaattcacgttctctactaattttagttaattcattgattcgtttaattaaattttcttcttcttttttgtccataataaacacctcactaaacaatgttagtttaccttaattataccaataaaaaaagactcaactactaagaacgcctgtttgccgagataatatttttttgttagaatactaataagtaagtaaatggagaaaaaattatgactgaaccacatgcaaataaacaattagaaattttacgttttatttacgatactgttgaagaacgagcttttcctcctacagtgcgagaaatctgtagcgcagtggatctttcttctacttcaaccgttcacggtcacctagcacgcctagaaaagaaaggctatattttaaaagatgccactaaaccaagagcaatcgaagtaactgaaaaaggtcgagaagctctgggaattaaacctaaagatattcctgttgttggcgtagttactgctggtcaacctatcttagctgttcaggacatcgatgagtattttcctcttcctcctgatctcgaaaatgatgctggcgagcttttcatgttacgtgtgcatggcgaatcaatgattaatgctggaattttaaatggtgatcatgtcattgttcgtaaacaatctagtgctaataatggtgagattgttgtcgctatgactgaagataacgaagcaactgttaaaagatttttcaaagaagatggctattatcgtctgcagccagaaaacgatacaatggatccaattattttacctgtggttcaaattttaggtaaagttgtaggtctatatcgtaataatattgattaaaaaatggtaggaaatgtcattcctaccatttttttgctatttaattagcggttttacatttaaccagtcttgcgcaattacttcggctaattttctattataaaaaacagctgcgggatggtattgcggtacaacgatatacttttctttagaccaaatataaccatcttttttatcatttaattctaaaattggagtattttcaataatttttccatgcacattactaatttcatatttatcatctagcaatcttgttagagccgtagtacccactgttacaatgattttaggtttaacacacttaatttcataatctaaaaatggtgcatgtgccaaaatttcctttttagtcggttttcgattaggatatttgattacttctttattttcttttttactaaatgtgtgcttaatactataaggacggcttctgacagcactagttatatatacatcgtctcgtttaagcccgattgaggctaaagatttcattaattcttttccagacgcaccgtgaaacgggattagcgactctatctcttctcttcctggcgcttctcctacaatcataagcttgggatgaactggaccagcaccaaaattaattccttccaatttcatcccctttgatctttccttaacttcagctaagagtttatctggatatttcattttcaatatattcctgtgccttcttcaataattctttcaattcttcataatttaaacaggaattagcttctgctaaagttgcccatttataatctccaatttcacttttttgtagttctattttttgacccgggttaaatctactcaaaaacaatgttacagtttttaatcgatcccgggcaattttataagtaatactttcctcaaaatcaaaatcataatctggttttagtcccacttcttcatagacttctctttgagcagcctgtacattattttcatccttttctagatgccctttcggaaagccccaagttcggttaagtctactttggacaagtaaaaattctattttattatttttaatacgataaacaatactaccagctgaatattcctgcatcttttttactcccttcttatgattgttcttgttgttttcattataagctaaattaaaattttcgaccccttcaagacctttatcttgtatttaattatataaattaaaattatttttcatcttttttgtttaatcgacaaaatgttaatttagggttacactttatgttgaagtagattaaataaggtgaaaaaattgaaaaaacaagaacaatctgaaagctggggtcagtggattctccaggtactaattctaaccgccatattttttggtatcttctttgtactaaataaatatgtttttgccaacttaactgtatctggaatttcaatgcaacctacttttgaaaataacgatcgtgttattgctcttaggcatgccaagattaaggaaggcgacattgtaattgttgatgcgcctgacgaaccaggagccgtatatattaagagagtaatcggattaccgggagataccattgtaagtaaaaataatcaaatttatattaatggtaaaaaacttaatcaaccatggttaaaggctggccaaaaattaattgacaatggagaggacggaatctcaggtactaaatatactaatacacaaaatttcactctgagttctctagctaaaactcaaaattatcgtcaattttatacttcaaagcaactaaaagaaatgcaaaagactaataaagttcctgctaatacttattttgtaatgggagatcatagaagcgtttctaaagacagtcgctatattggaacaattccacgaagtaaaattgtgggagtagtaaagctgcgctactggccactaaatcacatcacattttattaatcaaaaagagtttcttttttgaaactctttttttatctacaaaaaaagccatctctttcgagatggcttttaatactgtcttgattaattgaattaaccgcgacgcttttcagcaattctagctgctttaccgtgacgttcacgtaagtagtaaagcttagcacgacgtacacgaccgtgacgaagaacttcaaccttagcaacacgtgggtcatttactgggaaagtacgttcaacaccaatacctgatgacatcttgcgtacagtgtaagttgcgctgataccagcacccttacgcttaattacaacaccttcgaacatctgaatacgttcgtgagtaccttctacaacacgtacgtgaacacgaacagtgtcacctgcacggaagtcaggcatatcatcgcgtaattgttctttagttaattcttgaattaatggatccattattttctctccttctacggcattcatcaacaccttgtgccagcggaatacccataaatcagtggcttatgccacaacgactagtttaccaaatagaaaaatgcttgtaaatactaattctctttttcacttttaatttcttcaagcattctcttttcttcatctgttaactcacggtcagctaacatatcgggacggtagagatatgttgctcgtaaggcttccttatggcgccattcagcaattttttggtgattgcccgatgttaatacttcagggactttctgaccttcaaaatcagcaggacgcgtatattgcggatattctaaaagaccgtgtgaaaaactttcttctactggagaagcagaatttcctaaaattcccggtaagagacgaacagtagcatcaatcatactcattgttggtaattctccaccagtaaggacgtaatcgccaattgatactgtttcatcagccaaatcatagattctctgatcaaaaccttcatagtggccacaaataaaagttaaattttcttcttttgaccaatcttgggccattttttcattgaaagtttttccctgtggagcagtaataattacttttcctttattagttaaagaatctagagctttttttattggcataatttgaagtaccatcccagctccacccccataaggagtatcatcgacatgatgatgtacgtcgctagtaaagtcacggaaattaactaagtttaattcccattttttgtcttctagacctctccccaacattgatacctgcaaaggagtaaacatatctggaaaaagggttaaaacattaattttcatctcgtaatccttcaagcaaagttacttctattctcttattggctagatcaacttttttaactactgattcaatatttggaatccaaaaactctttcctttttctggctttatctcccaaatatcattagcaccaggagtttcaatgttttctaatactcctagcttttctccagtctcagcatcatagaccgggcaatttaagatgtctttaaagtagtagctaccttcaggtaattcttgttgatctgtttctgctacatataattctttactgcaaattttttcagcttgatcaatatcatcaatcttttcaaatttaactaaataaaattgtttatggcgtcgagtattttctacaattaattcttcatactgtttattattcttaataaacaatctacttcctgtagctaatctttcctctggaaaatcagttgttgcatttaccttaacttctccctttaatccatgaggagacaatatctttccaacttcaaaatattcagtcatagaacttattctttctaaataaaaaagtttgggaagagctttcccaaacttctaattgcaatagtaaattacttaccgtactttgcgtcgtggtatctagtcatcaaaccagcttttgaaagtaagcttcttacagtatctgatggttgagcacctttttcaagccattcaaaaatcttgtcttcttcaagcttaacttcatcagggttagtaagtgggttgtagtaaccaacttcttcgatgaaacggccatcacgtggcatacgtgaatcagcaactacaatacggtaaaaaggttttctctttgagcccatacggcgcatacgaatcttaacagacattaattaattcctcctaaatttcttgacttaaataatatagcatatagaaaaatatgtgtaaaggggttttccttaacagttgaaaattattttgaacgataacgcttaatattcttcatccgtttcttcttatttttcttaaagcgcttattcattgatctcatcgccatcttgcccattggtgaattcattcctggtaagttagccaattcacccatatcacctttggtcatcttttgcatcatttcttttgattgcttaaattgtttaatcattcggttaacttcagcgatcgatctaccggaaccagcagcaattctacgtcttcttgacggattaagaatatcaggattttcacgctcttctggggtcattgaataaacaatagccttaatgtgatcgatttgtttttccggaatctgaatatttttaagagcaggattattacccaatccagggatcattttaatgatttgatctagaggacccattttttgaacttgctccatttgatcaataaaatcattaaaatcaaaagtattttcccgcatcttttcagccatcttttcggcttctttagcatcgtaatcttgctgagccttctcaattagggtcaacatatcacccatacctaggatacgtgaagccattcgatcaggatggaaagtagaaagatccgttaatttttcaccttgaccggtaaagataattggaagaccagtgacagcacgaatagaaagtgcggcaccaccacgagtatccccatcaagcttagtcaaaacaattccagtcagatctaagtcattattaaatccttctgctacttgtgtagctgcttgacctgtcattgcatcaacaactaataaagtattatcaggatgagcaacttcagttacacgtttcaactcatccatcaattgctcatcaatttcaagacgcccagccgtatcaatcaagacatagtcatttttatttttatcagcttcttcaagaccatgctttacaatttctgctacatcttggttatcttcactataaaccggtacgtctaattgttgaccaatttgctttaactgctcaatagcagctggacggtaaatatcacctgcaattaacaatggacgagctttttcgttcttcattaagtaatttgcaagtttaccaacagtagtagttttaccagtaccctgtaaaccgaccatcataatgattgttggaatatgcggagatttattaagagaaacagcctcttctcccatcattttagttaactcgtcatcaacaattttgatgatttgttgtcctggatttaagctatcttggacttctttacctaaagcttccttttttatttttttaataaagtcttttacaaccttaaagttaacgtccgcttctaataaagccaatcgaatctcacgactagcgtcattaatatccgcttctgagatcttacctttaccagttaaattttttaatgctttttgaagtctttcacttaaattttcaaaagccatactattctactcccatttgtcttaataatttcaaaagttcaatctgagctcgattaattttgccatgttcaagggcatatactgcctcagtaattttttcttctatttgagtataatcacgtttcatatgaagtttatcttcatatttttctaaagcacggctgcttcgtttcaaattatcataaacagcttgtcgagagacatggtgattatccgcaatttctcctaaagaaagatcattgtaataataatcctcaaaatactcttgttgtccttttgttaataatggaccgtagtaggcaaataagtcgcctaatctttcatttttttcaagttcatccatttgtctcaccttgaaacagtatagcaaaaaaaatgtatttctaaaataatagctatgtagttttaagacacttttagtttaattaattttcaaaaaagaaggttaggcaactttcctaaccttcttgtatacgaatcttttaattaaagatttggatccattttaaatgttaacttagacatcttaattgcatcagtaaacatttgacccattaattcttcactatctttcttagtatgagcaacagtcttttggttttcacgagtcaagtagtcggttaattcctcaccgtttaaatctttagcattttcaataatttcttcaactctaccgcggtagtatctattcaactcttcaagatatttagtatcaagttgaacaaattgaggataatggctttcaactaaagcagccaaagatttgtagtaccaccatgcatcatctttattataggtcattgacgtattgttaaatgatggatcagtttcgttcatattagcaaagaatgggatatatggggtaaatgttggtccaccaatacataaccacataataccagccatttcttcaggaacatcacttctaatttgcaaaatatgtgagttctgagttctatttaaaccaattggacgataacgatgcttctcttcctcagttccatgaccaaacggatcaaatggagtatcttgataatgagaaccaagtgcaaattcaatatcttccttagccaatttcttagaagcttttctaatgaaaggaatatctggatcttcaggatcttgttcaatttctgggttgaaaagtttttggatataccattgacggctagtgttgtagtgacgatcttgttcagtataagttccaaaaatgtgacggaaattccaaccttcatgatcaggatttaagtgatgttcttcaacgaattcttgaattccttcactccacataaagttatctggatcatcaaagttaacttgttgaatagcaacacggttaccagttgctgcataacaatcatcgggaatacgttgagcaacccagtggtgtcccgtgacaatttccatataccatacttcatctttgtcaccaaacaaaactgagtttccagcaggtgaaccatactttttaattaaggaaccaagacgttttacaccatctcttgcggaatcaatatatggcaaaactacagtctgcatacaatcttcatctaaaccatctttaactaatggatcaaatgctaacgttctttcgttaccataagttgattcagtacatgacatagcaacattcttttggttgataccgctttcgtcataataacctaactttttatagtcaacatttggaactgctggaactctttgagcatcttcaggaagctccatttcaaacttattaagccaagatttaattttacgtcccttttcaccatgaacagctggctcaataataaacttttgtggcgtaattgcacctgcagtatcgtcattacgtgaaatcattactgatccatcaattgatgctttttttccaactaaaatagtcgtacatgcacttaaatgcttcattatttactccttatatattacttgtaactttgcctattattagattaatccttggaagagcccgattgcaaatttttctgcatcaaagtttgctaaatcatcaactttttctcccagcccaactaatttaactggcaaatccatttcatttctaattgctaatactactccacctttagatgagccatcaagcttagttaaaactaaacctgtaagtttagtagttttatcaaagtcttttgcttgtagtaatgcattttgacctgttgagccatcaaggactaaaagaacctcatttggttgatctggcaagattttctttattgttcgcttaattttatcaagctcgctcattaaattgaccttattttgaagacgacctgctgtatcaactaataagaaatcgattcctctctctttagcttttttaacaccattataaactacagaagccggatcagctttttcaggaccagtgattacttcaacgccatcacgtcgaccccattctaccaattgctctacagcaccggctctaaaagtatcggcagctaccatcatgacagacttgcccgagtctttaattcgcttagctaatttaccaattgttgttgtttttccagctccattaacaccaacaaaaagataaacattaggctttgcagaaggatcatcggctaatttagaatcttcaccttccccgcctttatcataaatatcgactaatttttcaactattacttgctttaaggcatcgtggctttttgcattttggagtttggcttcatcccttaaagaatcagttaattcttcagcagtttcaaaaccgacgtcagattcaattaataaatcttcaagatcatcaaaaaagttttcatcaactgttctaaatttagcaaaaaatgcatttaggcgtgccccaaaagaatgattggttttttctaaccctttgtcatatctttcctgttcatcttctgtagttacttcttcagcgctctcttcagaagattcagtttcttcgggcttttcttcttctttttctaaattagatgattcttgatcttcttgaagatcttcagcttcttgaacttcatcctgtttttcttcaaaagcagttccggcatcactccagcctggagtctccttaacttcttcagtttcttcttcagtttcttcttcagtttcatcttcagaagattctgacttaggttctacaacctcttcatttttttgaatatcttcagcttcattggtttgttcaggctcttgaagttcttcatttggattttcagttagttcttttttactttcttcttgttcttcatctttatgaccaaagagcgatttcttgattttatcaaataatcccactactaattcacttctttcttaatttcatttaacgatacagataacacttttgaaatacctgattcttgcattacgattccatacaaattatctgctttctgcatagttccacgacggtgtgtaataacaataaattgagttttcatatcataatgattcaaaaactgagcaaaacgatcaacgtttgtttcatctaaagctgcttctacctcgtctagaatacagaatggtactgggttaacttgaagcattgcaaacaataaagtaattgcagttaatgccctttccccaccagaaagaagcgttaacttctgggacttcttaccaggtggctgcgcaataatttcaattccagtttcaagtaagttctttggatcagttaactctaatctagcatgaccaccatcaaacataattggaaaaatctttgcaaagcttctttctatctggtggaaggttgcactaaacctactctttacctcatcatctagtttagacattgattcttcaatatcttttctagcctttagcaagtcattctgttgtccatttaagaaatcataacgcgttttaacatcttcatactcttcaatagagttcaagttaacctcaccaatatctgctaaagacattttatgtagatgaacttcacgttccaatttcttacgcaaatctgttgtattttgtccctcagataattgcaaagctgcttcaaaagttaaggaatattcttcacttaaaataccaagtttttgattaatttgggacttaagttctcctagccttgcagaatactcttcttgctccgcagcagtatttttacgcaaattataatttcttgtagcaacttgatcaagattatttatttgagcatcaaatttacctaaatctttatttatttcagctaaagcctcttgcatttgttttttctgcttacttagcttagcaacttgctcttcaatttctgactcactttgtccattttgagacaatgacaaagctttaattttttcctcaatatccttaagtctggaattggtattttcaagctgttcttccaattcagatttcttagtagtaatattttccaatttattctttactacggccaagtcggaatttaagttacttaattctgcctgtaatttttgataagcttcatcaaaatcggtcaagtcagtctttaattgatccatttttgctcgttgtgtttgagcaacttcttcaagttctttctttttagcctgctctttttcaagacgactagtaagttctgcttcttcttgcttcttctcaagttgggccttttgctgtaaatcatttaactgagtcagcctttgaacctctttttcttcattttcatacttaatagcttgctcactgattttttgatttagggcagttaaatcagtatttttagcttctagctcagtttgtaactcggttaattttttatctagttcgtttagggctgtttgtagtttagtaaattctaccttccccgtcttaatttgtaatgttaatttatcaatctcagcatttgttgccagaggagaattatttcttgtatttctagtcccaccagtcatacttcctccaggactaataatatctccatctagtgtcacaattcgataatatcttccaattctgcgttgaacacgtaaagccgtatcaatattatctaccactaaaacattccctaaaaggtaagaaatagcattagaaatatcagtcgcagtttttgaggttactaagtctgccgctacacctttaaatccttcaatactttgtaaggagtttaaagtggaggcagcaatctcattatgacgtaatccatctagaggtaaaaaggtagccctacctgtacgagtttgcttcaacaaattaatggcatccctagcactactttggtcaatagtaactaagtcttgaacgccaccacctaaagctgttgacaaagcggcttctaattcagctggaaaagaaattaactccccaataacccctacaattccatgaaaatcactttgatggtttaaaacatatttaaccccataatagtatccttcatgtctatttctaattttctttaggccttttacttgtgcagaaagttgttgtaaatcatttttaacctttaagtaagcttgttcactttgatccttaagcttactctcctcagcaatttttctatcaagagtcgcaatagtttcatttagttgttttctctttaaaacaaggtcttgcccttgtttttttaactgagtaagaactttttgagcttcatctaattgttcttcaacttcttgctggcgattatcatttgattttttactgcgagttaattcatttttcaaataaacaatctcgttattattactcgtttgatcctgcaaagtttgaatataatcagatcgaacttgttctaattgattattcaattgttcaggaccttgcttaagttcctgtttcaaattcttttgcttttctacgaaatcagcaaggacttgattttgactgtttagatctttttcattagctgcaagctgatctaacaaacgttttcttcgctcttttagctcttcagattgtgcattatattccttttgagtagcgacatcatattctcgagattgttgatgcatttgaagatcagtagtcagagcggcaattttttgtgttaaagataataattcttgctgcttttcatctttttcagcatggcgctcatttgattgcttacgtttctcttctaaatcagcttgggattgcttaacttcgtcatcaagcttatttaaaatcccttgatttgctgccgccttcttagcgaccgccttcttctcttcatttaaactttcaatctccaagcccaaaagttgttttaatttatggtcaagctgttctttctgaaatttatattcttttgctaaagaactctgttcatgtaaaggctcgattctaccttccaattctttaaccaaatcattaattctaattagattggcattagttttgtctaactgcttaagtgcaatttctttttgctgcttaaaatgaaggacgccggcagcctcttcaaaaattcctcgacgctgttgtggcttagaattaagaatttcatcgaccttcccctgagaaattattcccaagctatcagatgacatccctgattcaataaacagtgtcctaacatctttcaatcttactggatgatgatttaaaagataatcactttcgccgttacgcaaaatttttctagttacaaccacttcatcattatcagaagcaagttggtgatcacgattatcaaaaaccaactcaacctcagcatgattcattggagctctcatttgactaccagcgaaaataacatctttcatattttcaccacgtaaagacttggcagatccttcacccattacccaccgaattgcttcagtaatgttactttttccactaccatttggaccaacgatgccggtaataccattattaaatctaattgtcgtcttatcagcgaaagacttaaaaccatttaaaactaattgttgtagtggcacagactcaccttttcttatttatttttatctaatgcagcttgagctgcttgctgctcagcggcttttttattacgtccttgtccctctgaaactttttcaccatttacaagtagctgaactttaaaagatggctttgattcatcttcagatattacttgatattcaatcttaactggtccatttacctgcaaacgttcctgaagttcagttttataatcacgtgaggcattaaaatctccttcagcaattaatggatacactgttaaatgtaaaaagtgctgtacagctggcattccttgatctaagaaaagtgcaccattaaaagcttcaaacacatcttcaagaagtgtcttacgttttctagcgccagctttttcttctcctttacccaaattaatttcttctgggaatccacattcaattgcaaattcagaaaatccttctgttctaacaatgttagatcgcattcttgttaattccccttcatttaatctaggaaaatgacgatacagataatcagataccgccaattcaagaacagcatcgccaagaaactctaatttctcatagtcctttctcccgggatgctcattagcataagaagaatgtgtgaaggcatcttcaagcaatttttcgttattaaattttattccgtattttttctttaaattttgtttaaaagctactgaaaccatagttgcttcctttctttaaccctttaattatacctattttaacctattaaaaaaagataaagaaaaagtgtgacctaatataagtcgcacttttaaataatttttatttattttgcatagccaacgtagtaccagttagggaatccaccacccatactcttagatggttctaatgagtatccagttaacttattgttaattgcgtaaatgctgtagctattagcaactggcacaacataagcttccttatccatgtatgcttgccattgatggaatttcttaactctgtagctattattaaaggctttttgagaatcaatatcgttcaacaagtcagtgttttctttagtgacaaatctactgtagttaaatggtgcctttgcgccgtataagtcttgaggtgatggctcagaagagagtgaccatgcaccaatgaacatatctacatctttagaatcattttgaaccttgtcgtagaatgaattcatttccattaaacggccaccagttaacttaacgttcaagcccattttcttccattgttgaatgtaattttgaatgattggttcttgaactttactaccactcatggcagctaaacgaattgttaaaggcttaccatttggttgaacacggtaagtccccttcttcttgtaaccagctttatctaatagttcattaccctttttaatgttataagtgtaaccctttacattcttatcgaagtaatcaccgaattgctttggaattaaagttggaattctaaatgaaagacctgatgagtatctcttataaacttggtcaacattcataccgtaggcaatagcttgacgaagagaacgattattcatctttgcgtccttattcatcacattttcgcctttggctgcatcccatttaccaaccttaaagcctaagtaactatatgcaagtggaatattagcgatgaagtttactcctttagcacccttaatatttggccattgagaattacttacttgcgttacatcaaatttattactcttaattgattgagcaactgaagctggagtaattacggaagcagttatcttctttaagtgtggtttacccttatagtaatgttcatttggaacccatgaaactgattgtccacgaaccactttacttactttatatggaccatagaataatggattcttacggatcttattgcttgaaataagtttatcaaatggaacatcttttaagtaatgatatggagctgctgcttcccaaatatatccattaccactttgtgtcatacccggcttcatttctttaaagtggagtactactgtacgaccattttcgccgtctggcatttcaatacctgaaatagtattggactttccatcatggtattcttctaatcctacaagattagctaaacttgaagtataacgctgagaatgtgttgccttatttgcaataatttcataggcgtattcataatcttttgcaactaaaggttggccatcagaccacttaactttaggattaatagtaatggttgcagttttggcatctttattaattttaatgtctgctgctccacccttaacgtatttataggtattatttgtagcaaataatgattcatcaccatattgcattacttctgagtctgtattgttagtagacaattcatcattaaaaataccagtaaacggtgtatcagtaactacagcaacgctgacatttccaccatccttaattgtcttcttaggagttgactccttgaaattaggatgactagtattattgctattactattaccacaggctgctaaagttaaagctacacctgaaagcaaagttaatgtaccaattaatttgcctttcttcattaatttttcctccaataacattggacaagttgatatatttaattttagcactgaaaacgattaaaacaacttaaataaaaaaaaggccgtcacttaagacgatctttatgaagaaatttatctaatattattttgcaattcctacattgtaccataagctgtttgctgctgatggtttagatgagtaacctgtaatcttgctgttaactgcatcaatactataactgttagatactggaacaacgtaggcttcatcatccatatatttttgccattcatggaatttcttaacacggtaattagtattaaatgccttttgtgaatccatttcttgaagtaacttagtgttcttagcagttacaaaacgactaaagttgtatggtgcttttgcattgtataagtcatttggtgatggttctgaagataatgaccatgcaaccatgaacatatctacgtctttagaatcattttggaccttgtcatagaaggagttcatttccatcaaacgaccaccagttaacttaacattcaaacctaatttcttccattgttggatatagttttgaataattggttcttgagtagagtcaccactcatagctgcaaaatggatagtcaaaggcttaccgttgggttgaacacggtacttacccttcttcttatatccagctttatctaatagttcattaccctttttgatattgtaatcgtagcccttaacatttttatcaaagtacttaccaaattgtgctggaattaaagttggaatatggaaagtcaaaccgttggtataacgtttgtttacagcggagatattcataccataagcaatagcttgacgtaatgctttattattcatttttgcattcttatccattacgttttcgcctttagctgcatcccactttcctaccttaaaacctaggtaacgataagataaaggaatcttagcgatccagttaacattattagtattggcaacgttcttccattgaacattgattacaccggcaatatcatacttatgactcttaatggcttgagaagctgagttagggttcaaaacttgaattgttactttatctaattttggtgtacctctccagtagtacttgttaggaacaaatgttactgcttgaccacgtacaaccttactcatcttatacggaccaaagaatagtggcttctttcttacttgatcagatgattgtagcttatcaaatgggatatccttcaaatagtgatatggagctgcagcttcccagaagtagccattaccactgaacttcatacctggcttcatttctttgaagtgaataacaacggttcttccattttcaccatccggcatttcaataccagaaatagtgttagatttgccatcgtggtattcactcataccaacaatattttgaagtgagtcagtataacgtgatgacttagttgccttgttagcaataatttcgtaagaatattcaacatccttagcagttacttgcttaccatctgaccacttaacaccattcttaattttaatagtagcagttttgttatcattatctaattttaatgtagctggtcctttgtcattaatttgataagtatcatcagtatcaaataacccttcattagcaggtgccatagcatcagagtcattctgagtatcagaaagttcatttaaaaagataccagtaaatggtgtatcagattcaagtgcaacacttactgtaccaccctttttaacagctttctttggagtagctgacttaaagttcttagttgggttatctacttttgaatttgaattgttaccacatgctgctaatgttaaagcaacaccagaaagtaaagttaaacttccaaatagcttggctttcttcatagttatattcctccatctatttgggacaagttgatgatttaatattatcatcatcaaactcataatacaatgttttcactcaattatttttaatattttttaattttaattcgactaaattgctataaagcgctgatatattaacgtttgttcactattatgtttaccataaaaaacttattttatgcccatttacaatatcaatatttcctacattctttagtttttatacaaagacatgcaaaaaagcaactcaattatgagttgctttttaatatttaaataatcaaatttaattttcacgttgacgagcatccccagctctttgaagagcacgaccaacatagttaatactcaaggaaatgatcaacaacataatagttgctggcatccataaccatggacgtgtagtaacgttaacagggtcattagcaaatccaattaaagtaccaagggatggtgtagtggttggtaatccatatcccaagaaggataaagtagtttcaataccaatgtttccggcaatcatcaatacgacatcaattaccaaagctgaagtaatgttaggcaaaacttcacggaacataattgttaagttagaagaaccggaagtcttggaagccaaaacatattctcgttctctctgggacaaaacaaatgcccggaaatatcttgcagttgaagtccacccaaacatagaaatcaataataccaaagtccaagcattgtagttaggaataacagtagttaaaacaatgatgattgggaacataggtaaaatctggatgaagtcaactatacgcatgataattgcgtcagttaccccaccaaagtaacctgagaacaaaccaactaaaagtcctataccttcacaaagtacagtaacagatagaccaattaaaattgagtttcgtccacccatcatcaataacttcagaatatcacgaccaccgtcatcagtaccaaagacgtgaccagattcaccccaagcataatatgcttctgcaatattaatctctgttacttgactcttatttaagaataaagaaccaacaaaagtgaataataagatagctacaataatacagaatgaaacaaaggctaccttatcacgccaaacctcacgagcaataatcttaaatccagatggtggtagagaggttttagcattttgatcttttttcgatgtatttttatctttagccataatttactactcctccctacttgatccgaattcttgggtcaataatactcatgataatatcagataacaagttaccaactaaagttaagataccaaataataaaattaaggcagttaaagttgagtagtcacgttgaccgatagaatcaaggaataacttacccataccaggataactgaagactgattcgataaccattgaaccagaaagtaatccagtaatagtattaccaaagaaagcagcaattggtaaaagtgagtttcttaaaatatgtttattgaaaacaacattttcaggtacacccttactacgtgcagttcttacataatcttcaactttgttatcaacaataccagttcttaagtattgaacaatggttgtagtagaaatcaaagcacaaagaattgacggtaaaatcaagtgatagaatctactccagaagtaagcgaaggttcctgggttaacatctgcacttacagaaccagaaattgggaaccaacctagagtaaatccaaatagccagatacctaagatgtagaaaacaaatggaggaactgcaaatgtaatgtagttaaaaatttgcactccgtgatcttgccattcatcttggtgacgaccggctgtaacacccaatggaactgcaattaagtaagttaaaacaacagtcattaaagacaaccagaaagtgttaactgcacgatcccaaatcaaagaagtaactggaaccttttgaatatatgattgtcctaaatcaccgtggaacatatttccaagccagcgagtatattgcacccaaactggatcgtttaatccatattcttgtcttaatcttgcaatttccttagggtctgaattcggattaatcattccagtaaatgggtcaccaggcatcattttagctaaaataaagactagtaaactcaagataagtaactgggggatcataatcaggattcgacgtaaaaccgttttccacatatctattctccctccttcaattcttgctcaatcatatctttaggtaaagcaacgaaatgacgctcgccaactttttgtagtggtaatacacgaccatctttttcataccatttatcttgatcttgcaaaaattcttgttctacacgttgacgctcttccttatgtttttccctattttcaacatcaacaacaggaattgcagaaagtagacgctttgtataaatgtgcattggattcttgtaaatttgatcacgtttaccaatttctacaaaacgtccacggtgcataatagcaatatcttctgacatgtgctttacaacacccaagtcgtgtgaaatgaagaggtaggcaatattatattcttgttgaatatgtttcataaagttcaaaacctgtgcttgaacagataagtccaaagctgaagttggctcatctgccacaattaatttaggatgagtggctacagcacgtgctaccccaattctttgacgttgaccaccagagaattcatgtggatatttgtagatagcatcactaggcataccaacaatatctagtagttcttgaactcgttttctttcttcatcggttgttaagttttcaaagtttctaatgggttcagcaataatatcttcaattcgttttctaggatttaaactcgacattgaatcctggaaaatcatttgaacatctttattgtagttaagttttttacgatttgatgctttagtaacatcaacacctttatacaaaatttgtccgctagttactttttctacaccaacaattgctttaccagtagttgatttaccggaacctgattctccaattagaccgtaggtttctccttctttaattgaaagattaattccatcaacggctttgacatatccagtaactctattccaaaatccagaacgaattggatagtgaacttttaaattttttatttcgattatttcatcggccataatttcctatcctttcttctcttcatcttggaaatggaagctttgccagcaagtacatcttacaaaatgtcctggttcaacttcatgaatcttagggttctcttcatgagcactagctggaatccaaggaattctagctgcaaatctatccccagttcttggcatgttaatcaatgaaggaactgttccatgaatcacatgtaggtcttcactttcatcatctgtttgtggcatagagtgtaaaagtgaacgtgtatatggatgaagaggattttcaaaaattgttttaacatcagctttttcaacaatttgtcctgcatacataactgctacttgatcagcagtttcagcaacaacacctaagtcgtgtgtaattaacacaatccctgactgagattctttttgaatttctttgagtaaatctaagatttgtgcctgaatagtaacatccaaagcggtagttggttcatcagcaataataatttctggcttacatgcaattgcaatcgcaattactacacgttgacgtaaaccaccagataattcatgtgggtacatctcatacatttcttctggacgaggcatcccaacttgattaaagagttcaattacgcgtgcatgacgagccttttcatccatatcagtatgatagtaaagtgtctcagcaacttgatctccaaccttcatcaatggattaagagatgctaatggatcctggaaaatcatcccaatattattaccacgaattttattaaacaatgattcatttaagttaactaagtttagttcattgtataaaatatcgccagttactttcgtatttttgtggtcgtacaaaccaataatgcttgaagcaattgtacttttaccacaaccagattctccaacaactgccaaaatctcatttcgtttcaaggttaagttaatgtcatcagcggcatcataaaacttaccgtgtaaacgatatgcggtatgcaagtgttcgatatctaataaaagatcactttgcttttccaaaggccattctcctctcaaaccttacgacattattaaaagtcaattagattttcaatttaatgtcattattataaacaaaagatactgctatttcaacaacttttataaaagtaaatgaaaaatgacagtatcttctgaaatttcaatgattaaaattttaattttggtgactcttaatatattctactgcttcaccaacagtttgtaatttttccgcatcatcatctggaatctctgctccaaatgtatcttctagatccattactaactcaacgaaatcaattgaatctgcatctaaatcattctgaaaatttaaatctttagtgatcttatcacgatcaatactaaagcgttctgaaatcatatcagcaattttattaaaaatttcctcttcggtcattttttaacctccaaaaaagtttagtttaattctaaggcatttttatattaaagtctagcgagattcactaaagtattttttatattctccaactagatcttgactcaacatcttatcaatttgtaataaagtgtagtaaataggacggatattcgatctaccgtgtgtctttacaacaggtgcatttaccccaagtaaaactgctcccccatatcttgccgtatcaaatcttttctttaatgcagtaagtcctggctttgctaataaggctcccaccttaggacgtaaaccattatttagcaaagaatccttaagcagacgtaaaattacgcttgcagttccttctattgccttcagagtagcatttccagtaaaaccatctgttacaatcacatcagccttaccttccattaaatcatttccttcagcattaccaataaaattaagatcagttgctttaagaagcttataggcctcttggtggagggcatctcctttatcatcttctgcaccattatttaataaagccacggttggatttttaatatttctaattttttgtgcataaaaattagccatttgtgcccattgtactaaatattcaggcttactttgtgcattcgcgccaacatcaataatattaaagccatcctcgcttttagcactaggaagagttggcattaaagctggacgctctacacctttaattcggccaataataaaaatcccgcaagctaatagcgcacccgtatttccgagggaaaataaggcgtctgcttttcctgactttacatagttagcagcaacaaccattgaagaatttttcttacgtctaattgcttttactggctcgtcactatcaataataacttcactcgttgcaatgacgtcaattctatctttttgctcggcgggaattagttcattaatcttttcttcatccccaaataaaacaaattttgtatcttttaattttggctttgcttttaatacagcatcaacaatagccttaggagcattttctcctcccatggcatcaattgcaattgttttcatattcactccggttatttctaattattattcaaatccttcttatattttagcacttcttgtaaaaatttattttctgaattaaccaaagctgggtcagacttaattaggttacgagcttctttttgagcagtcactaaggcattatagtcatttactacatccccaacttgaaactgaggtaaaccagattgagcctttccaaaaacatctccttcgccacgtagttttaaatcttcttctgctaatttaaaaccattactggtagaagtaataatgttcattcgtttcttaccaatttctgtttttggatcactcacaaacacacaaaaactttgtgtctgcccccggccaattcttcctcgcaactgatgcaattgacttaagccaaagcgatccgcattaaagatcaccatcatatttgcattcggaacatcgacaccaacttcaattacacttgtagtaactaaaatattaatcttgcctgcagcaaagctatccataatttcatttttctgatcgcctttcatctggccatgaagcaaaacaacattttcgtctttaaagtaatgagcaatttttgcttgtaaatcctcagcgttttttaagtcacttttttctgattcactaattaaaggagttacaacataaatttgaaaacctttatctaactgtgaacgcatcaaatcaagcacctctcttaatttgctggaagttgcccacgaggaaactactggctttctcccttttggcaagtgtctaatttcagaaacagccatatctccgtatacggttaaggctaatgtacgaggaattggggtggctgtcattgctaggatatcaggtgcgtcaccttttttaatcaacgtatttctttggtttactccaaatctgtgttgctcatcaatgataactagaccgagatttttaaaatgaacctctttttggattagcgcatgggttccaatcacaacattgattgttccatcagctaattcacgataaatttctttcttttctaaatccttagtgtctcccgtcaataaggcaactcgaacacccaatggcttcagtaattcatctatcttagcaaaatgctgctgcgctagaatttctgttggaaccattaaagcagcctgatagcctgcagtaacagctgcataaattgcaaaaaccgctactacggttttaccactacccacatctccctgcagcagtcttcgcatttgtcttttagaatgaagatcagcaaagatttcattcaccacttttttttgatcatcagataactcaaatggaatttcttcaattaattctttgacagcagctaaatcatatttcttttctactccaggtgcgtcttcatttctttgggaaagaagttgagccagttgcatttgaaaaagaaaaaattctctaaaaatagcacttcggcgtgctatcttcgcctcattgccattttttggatgatgcattttttctaccaaaacgcgatcagaaagcaagcgatatttttctcttatagaagctggaattgtttctccaacttcatttatagcttcctgtaaagcaagatcaattaacttttgcagcttattttgcttcaaatgacgattgacagaataaataggagcaaaacctgaatctttcttttcagctactaatttaaagccactgaatgactgccgcgccacttgatacttgccatatactgcaacttccttacctgattccactttatcctttaaccagggctgattaaaaaaattgaccatgataatgtcatgatcaatttttattttaaagctgagccttgtttttcgataaccaaatcggctaacaaatggatctgttaccaccattccctttaataagactttctgcccatcttcaatttgatcaagaggaattgtctctaaatcatcatatctaaaaggaaaataaaatagtaaatcataaattgtgttaatgccaagactggccaaagctgtagctgtctttgctcctacaccttttaactcagttactggttcaaataacttactctgcttattattcatattttattccacggatactaagaagtagtaaactggctgaccaccatcatggacttcaaactctaaatcatcatgagtagctttaagttttttaactacttcgtcagcttctgctctggtagcatcactaccatacataatagtgataatttcactatcttcatctaacatcttttcaatcattgaaactgttgtatcaatcaagtctggattatcaaccttaatggttccatcaacaattccaaggtagtcatcttttttaacttcaatatcatcaatcttagtgtcacggattgctttagtgacctcaccagatttaaccgtatctaggtcttcagacattgcttcaacattttcctctactgaagcatctggatcaaaggaaagcattgcagttaatccttgagaaattgtctttgttggcacgattccaaccggaatttcactaacttcagcagcttgcttagcagccatgataatattaccgttatttggtaaaataatggcctttttagcaccggagttagtaatagcatccataatatccttagtcgatggattcatagtttgtccaccagaaataattctatttacgccctcactcttaaataattcacggattccatgacctgaggcaactgcaataactgcaaaatcaacattttcttcttgttcttcgctattttctaagatagtttcatgttgaatccgcatattatcgatcttaattttacctagttgtccaaatttttggccgtatgtaaaaacatctcctgggtgttctgtatgaacgtgaactttagccacttcaccatctgaaacagctaaaagtgaatcacctaagttagatagatgttctctaaattgttcaagattgaattcttctttatttggaacatcagcagttaggtcaaccataatttcagtacagtaaccattcttaatatcactagttgataattgaacttgagcagattcagcttggtggtgagctgcattaattaactcatccatttcaccttcatctagttggtagtcatcattatccttttcgccaagaaccccctctaaaaagccttggtagataaatactagtccttgaccacccgaatctactactccaacttgctttaaaactggtaataaatcaggcgtagtcttcaaagcctttttagctccatcaactaccgctctcattacttcgctgacatcatcagtttcgtttgccttatttttaccttcctcagctgcaacacgagcaacggttaaaatagttccttcaacaggcttcataactgctttatatgcagttgtgacaccatttgcaaaagcattagctaaatcttgagcagttagggtatcttttccttcagtagctttataaaaacctctaaatagttgagaagttataactccactgttaccgcgagctcccatcaacattccttttgagagactttcagttaggtcaccaacggattcactaagattttcattaacagcttttgcgccgctctcaatggttaaattcatattagttccagtatcaccatcaggtactgggaaaacatttaatttatttacaaattcagcgttcttgcccatgcgatgagtcgctgcacgaaccatatctctgaattgatcactattaatttcagttaaaaccacaattaactcctccagaatgcattaatcgtctaaaatctttacgccttgaacaataacgttaaccgacttagtcttaatgcctaaaagattttcaagattgtattttacactatcttggacattgtgacttacttccgaaatttttagaccataacccacaataatatatacatcaacgacgatttgattatcattagttttaattacaacaccgcgacgataattttcacggtttaaaatagtataagctccatcccgtaaagcgttctttgaagccattccaactacaccatagttagaagtagctgctccacctacgacagtagcaattacactatttgaaatatcaattaagccatattttgttttaattttaacagccatcgtattcctccattaacgaagaacaattttttctcaatttattttaacacagcaggcttttatatcaacaatgttagtttcaagaaaatagaaagacaatattgcacaattctaaaagctgtgataaattaaataagtactacaacaacataaaggagggtttagcacaaatggcaaaagacattattactggccgcaagacggtctttggtaacaagcgttcaaaggctttgaactccgtgcggcgttcatggaagccaaaccttcaaaaagttcgcatccttgttgacggtaagccaaagcgtgtttgggtatccgctcgcgctttgaaatccggtaaggttaaacgtgtctaattaagaagtaaaaataaaagggatcaagaaatatttcttgatcccttttattttttatctcgactattgattacgattaatgtcccagactcacacgaaatctctattgcttgcctattcaaatattcatttgatgaataaactgtcggtacggacaaatcaatgggttttaaatcatatctcgcatttttaatactaaaatttttagctcctgttaaagttccaattcctaaatatttataatcagcttcataagaaagtatgtgcttcccttttccaaaaaagcggataatattttgcttatcaataaatttaattttttctttaaatctatcaaacggagctttcagcatagcatacatattaacaaaaaaatgatccattcttcctcctgttgctccatataccgttaaactgtcaactcgataatcgataaatgcggcataaaacaacatttcagaatccgtaaaatctttgattggattcgaataacgcatatccttaactttactttcaacgatttctctttcatcaaaagtcaatgaatcataatctcctaaggcaacgtcaggtactatccctaactctaataaaaaaaggctgccccgatcactagccataattagggcgccttttttacttgcttctttaatttcagtggctaaattatgtggccattcttcttttggaccacctaataatgcaattgctctcatttgtcttcttttttcaatttcataacttgatcttcaatacttccatttttaaaaatgtaagaaccagctacaaaaattgtggctcctgcgtctctagtaagctttaaagtcttaggctcaattccaccatcaacttcaattggaacacttaaattctcagcttcaatcatattcttaagttcaactagacgctcaactgactcttcttcaaacttttgaccaccaaaaccaggtttcactgtcatcaaaagcacttgatctaattcttttaaaaatggctgcaatttttgtactggtgtagacggattgattgccattccgcatctaacattatgatcttttaaatatttcagccaatattcaggattatcagttgcttcataatgaaattctaaaagatcacatccagcttctacaaagagaggcaatgttgtttctaagtcattactcattaaatgaatttcagcatctgttaacggaaaagatcgtttaaagtcttttaccaattctggtccatatgacaaattaggtacaaagtgcccatccataatatcaatatggaatctatctatgccactttcaatagctgctttaatatcacgacttaaatgcatattatctgcattcaaaattgatggtgctatcatagtttcacctatttctttaaatactctggcattctattgtcagaaatttcttgtctaatttttaaataagattcataacgactgcgcgctattttaccctcttctacaagttttttaacctcacaaccaggctctttaatatgttgacaacctctaaatttgcagtttgcacttgcttcttttaaatcataaaagtaatttcttagatcatcaactttgatcttaaagagatcaatagctgaaaaaccgggagtatcagcaataaaaccagagccgtatttaaatagtgttacttgtcttgtggtatgttttccacgatttaatgcagttgaaattgcccctgttacctgctttgcttcactctctagctggtttaataatgttgacttaccggcacctgattgcccagctaaggtccaaatctgatccttatcgatcatttttggaagttcattttccagtttttctgcatcttcaaaaacaggatacccaattctttggtagtattctaactcagtttgaatatcttttaatctttcagaagaagtaatatctgattttgacaaataaatgactacgccaacatttttccaagcaaaaaatgttaaatatctatctaataattcaagtgaaaagtcgggctcgacagcggaaattactaacaatactctagacacatttgccactgctggccgtcctatttcattaatgcgtggtaatatttcaattaaatagttcatcccctgatcatctagctgaactactactctatctcctaccagtggcttttgtttgcgatctctaaaaactcctcgggctctcgttctaactactttattatcaatttcgacatcatagtagcctgaaatagcactaataatcgttccttctgcttttttcattatttattaacgtcctcatctaaaatcgtttcaccatttcgcaatatctttatatgtccattttttttgcttaacttaaacggaatggtaaaagtttgttcagaagtaatattcatatctttgtaaatattattaattgaatgaccatcatcagaaacatatacctgaatatgatctggcgttttttctgatccgctttgatcagcacttcctggataattaatagtataagattttgtaacagtagttgtagtagttgaactgcttgaagtatcagtagaatcatttctcttagcttttgctactactactgttaacctatcccctggattcacatcagtacccgattctggggattgacgtaaaaccgtaccatcatttttaccatctgagtcttcttcttcaactttaagtgatagatgatgttcccgtgcgtaatctcgggcacctttcaatgaatatcccacgatatctcttaattttattgtatttcgtctagatcgagtactactcgccgaactaggccccttcgaaaccaacaaagtcactgttgatttattaggatttacttcctgacctggttcaatatcttgagcattaacctggtttttaggactaggagagtattcttcagttttagtaacagtaaagcccagtttaaccagctgtttccgtgcaagagaataagactctccaattacatttggcatttcaacaagatgactacctcgagataaaactaagttaactttttctccatcttttatctgagatccaatcggagggtctgttctaattacttctccttttggaacactatcagaatattcataagtaatttttccaatttttaaattagaagattgaagagatttcttagcctgcgtctgactcatacgattaatattaggaatatctaccatatcttttctaccaagagcaaagaatagaattaccataattacacaaaatgcaattatagctcctagccaccaccatgtatgacccttaagatttttaaacagactctttttttcttctttaggttcttcctttgcttgcacttcatgatctttattatgaacgcttccttcaagaggaggaacaacaatagtttcatcagtagacggatcatgctcgggcttaaaaatcggctcatccttacgttttggatcaagacacgtatccaagtccgctttcatttctaaagcggatttataccgatctcgtggatcttttgctgtagctttaaaaacaacattttctaaagcttggggaacgttaggatttttatctcttaaagatggtgttttttcttggaaatgctttagagcaactgcaacagcattttctccagtaaaaggaactgtaccagtcaataatttgtaaagaattattcctaaagaatagatatccgattgttttgttgccatactgcctcgggcttgttcaggtgacatataatgcactgatcccattgcagtattggtttgcgtcatcgtactttgatttaaagcaattgcaataccaaaatccacaattttaatattgccttttttatccattaaaatgttttgtggttttaagtcgcgatggatcacattgtgcttatgcgccaatgcaacggcacttaatatttgatccatgatatcaattactttaggcaaaggaattggattattatgttggatgtattcttccaaatcagatccatccacataatccattactaaataatgacaatttccgtctgttcctacatcaagaatcgaaacaatatgcggatgacttaattcactagtagaaagtgcctctctttggaaacgttgaatagtttgaggatccttttgcaaatctagtcgcaaaactttaactgcaacttttctttgcagaataatatcttcagctaaataaacattagccatcccgccttcgcctaaaacagagataatcttatagcgaccaccaagcaaatggcctttctccattgctatttgtcaccatccttttctacataggcaagcaaacaaacagtaatattatctccaccacctaaacgattagcttcattaataagtttattacaacgctcttttaaacttaaatttttagtggcaaggatttgttgaatttgaggatcagttaacgaatttgttaatccatccgtacaaagcaaaaaaatatcaccagcatgtacttcaagaatatcaaattctggatttacagtacttgagactcctaaagtttcagtaataatatttttttgaggatgatttcgagcttgttgctcggtaatttggcccattttaactaattcatggactaaagaatggtcttcagtaatttgcttaaattcattacctccatagagataacaacgtgagtcacctagatgggcaattaagatcttttccgtaaaggcaattgctaaaactattgtggtgcccattccatttagatcagaaaaacgatcggctgtattcaagatagtttcattttctaatcttaattgtacagttaaccatttttgagctaagtcaggatcagtaaaatctgttttttcaaaattatgacctaaatgactaactgccatcgttgaggcaacatctcctccttgatggccacccataccgtcacaaacgatccccataataatattattttgatttttaaatacctttacaaagtcctgattagtttctcggactctaccaatacttgaagcaaatgctgttttaatcaaaattatttaccctcgtttttttaattttgcaataaaaaatccgtcactgccgtcactacttggaaaaatacgtaccatttcttgcttaggaagctttcctacttgaactggtatcaactcaaaatcgggatgcaattttagaaattgcttaactactccttcatcttcttcatagctgatggtacaagttgaataaaccaattctcctccattagctaaaagcccactcacactttccaaaatagctaactgaatctttgctaaatttttaatatcatttagtgatttttcatatctaatctctggctttcgcctaatcaaccctaagcccgagcaaggcgcatctactaaaattttatcaaattgtccttgattaaaatattctttcgcctttcgtgcatctaaagccttcgtccttactttatcactaacatgaagacgttcggccgcatttcttacaagccttagtttattctcatgaatatctaaagcaattacactacctgttgtcaagttttcagcgatttgaaccgtcttaccaccaggggcactacatgcatctaatacctgttcactccccttaaagtaaaacgcatccacagcaagtgaagcagcagcatcctgaatagtaatttttccatttttaaacagagcggtttgcgctactccacctttattcaaatttaaattatgcggagttagactagactcttcaaaactaaaattatctttttttaattcttctttgatttcttcaaagtctgactcttttgtagtcattctaattgaattagcagcaggttgattacttcgtactaaaatttcttttgttttattttcaccaaaatgatctaataaatattctactaaccatttaggaaaactctctttaatacttaaatattcaactaaatcattagttggtggcaaaatttcaccttgacgctctaaagcacgcaaaattccgttaatcagcttataactgccactatttctcttactatattttttagcaagcttgtttgcctcatcaaaaatcgcgtttgctggtactttctctaagaaaaagtactggtaggcagacattaaaagaagcggctttaaaaaactatcgcgtagttttgttttaattaacggttttaattgatactctaaaaatattttatattgaattgtaccatatacaattctagtagctaaggccttatcagctggctttaaatcatgttttattagttcattgtttaaagcaatattagaatagcttttttgattaaaaactttgatcaaagtttctaaagcaaccgttcttgcattactcatcaattatcttatctccaattgtaaaatgactaccttgaccattgagataatctttaatattcattttcttcttaccagttggctgaacttcaagtaattctaattggctaccatcagccatactaattacgaatttctttttattagtaactaaggttccagctggaaaactagtcttttcagtcaatggctttgctttccaaactttgaatctctttccaccaagcataaagtaagcacctggatcaggattaagggcacgaattagattattagcttctttagcagtcattgataggttgatcttttcttggtctttagagatattaggtgaaaagacaaccttatcctcatcctgagcagtccgagtaactgtcccatcgataaacttaggtaaagtttctaagagaagatctcttcccaaaatacttaacttatcaaataaagtaccacttgtatcttcatctgtaattggcaaagctttttgggcaaaaatatctcctgcatccatctttttcaccatctccataatggtgacaccagtctctttatccccattcaaaacggaatattgaattggtgcaccaccacgatatttagggagaagagaaccatgaacattaactggagctactttagctgacttcaaaaacttcgttggcaaaaattgcccataagcagcggtaataataaaatctggttcaatcttcattaattctgcaagttcttctgatcctgacaatttagcaggttgataaactggaagattatgtttcaaagctgtttccttaacagcagattgatggactacttgtttacgcccaacgcgcttgtcaggctgagtaacaaccgctttaatttcatatccttgttcaattaatccttgcagaacgacactaccaaaatttggagttcctaaaaaaataactgatgacatagattcaacttctttctaaacttacattattctctctggttcattatcaatatatatatttaaaccacgtttttgtgctaattgtgcatcatcttgaatttgatgaagcaaatcatgcaacttaggctcatatttatattttaccaagatttggtaataatattgatttttaattttagctacactacttggcgtcggacctaaaataatagtcggagcatgtaactcccgcattaactttctttttattacgaatgcctctttagcagctgactgttcattttttgatgtaatagtaattaaggtagtataaaaaaatggcggatagtttccttgaaatctaacctgcatttcttttcggtaaaatccctcgtaatcttggctttgggctagttttattgcataattttccggattataagtttgaatcataactctaccagttttttcagctcttccggcccttccagctacctgggttagtaaatcaaatgttttttctgaagaattaaaatctggaagagataatgctgtgtcagcattaattactcccactaaagtaacatttggaaaatctagtcctttagcaatcatttgtgttcctaagagaatatcggcttgatgattaccaaaactatcaagaattttcttataacttcctttacgtctagtagtatcaacgtccattcttaagatcttagcgtcaggaagtaaagtttccagttcttcttgaactttttgcgtccccgtacctaaaaatcttattttttcactctgacaatttggacattttcttggaattggctccttatggccgcaataatgacattgcatctgtccagtatctttatgtaaagttaacgagatatcacaatttggacattttaaaacaaagccacaattgcgacaaagcataaaactagcaaaaccacgacgattaagaagtaaaataacttgttcttttttagctagtttttctttaattgcatctactaagggaattgatagatcaaactgtccaccagcaaattcaacagtttttaggtctattagatccactttaggtagcgacttttgattagcacgtttagtcagacgcaataatttatatcttcctttttgagcccgcgcccggcttgctaaagaaggcgttgcacttcctaaaacaactggacaattgtgaaatttacttctcaatagagctacatcccgtgcatggtagcgaggagtatcgttttgcttataggaagattcatgctcctcatcaattactattaaaccaatattttttaaaggagcaaagatcgcgcttctagctcctactacaacttgagcttctccacgcctaattcttcgccattcatcatatttttcaccttcagataaaccactgtgtaaaacagcaacattatctccaaaacgctctttcacttgtttaaccatttgaggagttagagaaatctccggaactaacattagagcattacgcttctgttcaagagctgtactgatagcgtgaaggtacacctcagttttgccgctcccagtaattccctcaagaagaaaagtcttagcctctttttctttaatactagtcccaattgaatttaaggcgtctaactgttctgaatttaatctaaccgaatgcttactagcattagattcaaaatcttttaatggatttcgataaatctcctgctctttttttaacagccatccctttttttcggctgctcgtaatgtagaacttgagattcctaattcagactcaatagttgaacccaattttggatattcgttatatttttcaacgatattattaagcaatgctcgctggttttttgctgttgttcttattcctcctaaaatatcctgatattctgttcttgttttagtcaaaagataggcagccacctgtttcttcttagctttattttcaactaagtattcaatcttagcttgattattttttatgagctttttaatttttacaattgtctcaagatcagaaacttcatttaaatcaagcggttcacctttaaaaagagtattttctttaatttcatctgtaaggggaactagaattttacgataattcgccttcattacgcgtggtaacattgattgaagaattgtaatccgatatgaaaaaattttatcagctaaagttttagaaagagcaattaattctggcgtaagtggtggcaattcatcaattacaacaagtaaatcttttaattttcctgtataagaagttgtttcactgattccgactacaaatccctgcacttttcgtcgaccaaaaggaacaaccactcttgatccaacagctacatcagttaattcctttggaatatgatattcaaacactcgatcagtttgtttggcagctacatctacaataacttgcgcaatcatttatcttatcacctactaaaaaaccttcattgattaacaatgaaggaaaagattctaaccaatatcttcacgatgctcaggatcaattgtaactttaccagcagcaatttcttcaagcgcttcgcccactgctttatcagacttatagtgttttaaagctaatggagcgcctgcttgaatctcatgagctcttttagcagctaacactgaaagagaataacgagaatttactcgagacagcaatttatcaatagatgggtatgtaattttcatctgttaatcctccttaaccatatttctataatcgttaattactcgcggtacacgcacgtgttcagcttcaacaatagacttaatatgatccaccgcattagcaaccgtatcgttaactacagcataatcataatcttccatcattaaaatctctttacgtgcctgtttcattctcatggcaattaccttgtcagaatcagtcccgcgattaacaattcgatgttttaattcatgcaaatctggtggtgtcaaaaagataaagacgccatctggcattaacttgcgaacctgttttgctccattgacatcaatttcaagtaaaacatctttaccttcattgagcatcttttgcactggtgcaagtggagtaccataatggttgcctacatattcattatattccaaaagctcgttacctttaattgcttcttggaaacggtcctctgaaacaaaataataatccttcccattaacttcgcctggacgaggcttacgagtagtcattgaaacagaatattcaaatgaaaaagctttttgcttcaccattgcacttttaacggtccccttaccaacgccagaaggaccagataaaactaataataaaccttgatgtgccattttcgctcctaaaaattatagtaacaagaatatattgcactaaaaaacgaggaatttcaagagtttcgcaaagagatataaattccacttgcaatcaaaaacatttgttcgtataatacatagtgcaaacacaagttcgggatgtatagaggaatgagatatgaatttattaaagtcgcttaataattatagtaaacaactttataattacttctttaattataatattaataagcttactacttttgcacaagacccaagtaaaattattagaattttagagcatgcactttttcataaagaatatatattactgacctatcaaaatggatgcactgagattggtcaactaatcaaaaggacatctgctgggcgcttcgtactagatagctatgatagcaacataattagaataattgatttaaacgagatctttaacgtcgaaacagcataaaaataaaggacttttcagtacaaatgtaattttcactttaaactgagaagtcctttattttattctttaaaactttccattaaatcagctgcatttctcttagcagcatccgttacatcagagcctgccatcatctgagcaattgcggtaatggcttcttcttgcgtaagaggtcctacttgagtataagtagctccatctttaacttgttttacaactgaataacgttgatctccagcagcagctacctgtggggagtgagtaattgtaataacttgtttttcttgaccgattgcatgcatctttttaccaattgctgctgaaactctgcctgaaactccagtatcaatttcatcaaaaatcatggttccaactggttctacacgactaaagattgcttttaatgccaaaattaaacgtgattgttcaccgccagatactattttgactaatggcatcaaagcttcaccaggattaggtgcaatcataaagataacttcatcagttccaagttttgtaaatgaattagtctcattaattctaatagaaaagcgtgctttttccatatacagatcagctaattctttttttattttttcttcaagatcgcgagcaatcttttctctctgttcatgtaaattttgggctttttgactaagttttttttcaatgattgcgagttctttttggatttttccctcgtctaaatctccagtttcaaacttatttagttcacttttaaccttttgtccgaatttaaaaacatcgtctaaagttgggccgtattttttcttcaaagtattcaatgtatctaatcgactagaaacatattgatatcgctcttcgtcaaagtccatttgatccattaaagtagatagttcactacgagcatcatttaaagaataaataccatcattaaggctggtagcaaaattttcaaattttttaccataattactcaaatcttcagcagcattttgggcatccccaagtaacgtagctagtccatgctcatcatcatcatataattgcataaaataattagctgtatctgcaattttttgataattattgagctcattaaattcttcttctagcttttcatcttcatttggatcattcaaatcagcactttctagttcattattttgaaattccaaaatatcctgtttttgagcaatttcttgagcatcttctcttaacttacggagttgagaagtaagatgacgccatttctcaaagtcagtttcatagctatgcaattctttcttaaattcaggctccgcataattatcaatcaaatctatttgtcgatcttgatccatcaaaatttgttgatcattttggccatgaatatcaactaaatttcgtccaatttcacgtaaaacattgattgtagtcagctgaccattaattctaactacatttcttcccttatgtgttaattctcggctaattattagctgatcatcttcaaaaggcagaccatatttttcacataaatcttcaataagatccttttgttcgcttaacacaaataaaccagtgatgaccgccttctcttcacccgagcgaatcatttcactttgcgcacgacttcctaagagtagagagacggcatcaataataattgatttaccagcaccagtttctccaatgagaacagtcattttttcttgaaagcgaacttttaaagttttaatgattgcaaaatttttaatatctaattcaactaacattttatctcacctaaaggccattaactgcacgttgaactacatcggaaggattacctttccataagtcttgacctggatttgctatgtcttttcctaaatgaataagaaattcaatatttcctttaccacctttaattggtgaatagtctactcccaaaatattaaaccctattttttgagcaactttcatggtatgtttaataacatttgcatgaacttcatgatcatgaacaatcccatgcttacctacattctcaggacctgcttcaaattgtggcttaattaaacacactgcatcgcatttatcttttaaaatttcatacattggcggcataattaaatctaatgagataaaggaaacatctgtcattgcaaaatcaggcaatccatcagtgaagtcgactggcttactgtagcgaaaattctgtttttccattactacaacttgaggattatctcgtaacttccaagccagttgattatatcctacatctaatgcatagactaacttagccccattttgtaaggcaacatcggtaaaaccaccagtggatgctccaatatcaaggcaaattttccctttcaaatcaatattaaatacttgcagggccttttctaatttgaatcctccacgggaaacatattttttaccatcatcttttatatgaaaaacttcatcttcaggaaatttttctccacttttatcaattctttgatgattatggtcattaactaatccagccataatagctctttgagcttgactacgagaattaaaaagaccttgttcaaacaacaatacatctgcacgctttttagacatttactataataccttctgatacaaattaaaaaattcacctaataaaggttgttcaaaaacttctatagcttttcttcctgattcaatcatttctacaagttgtttacgactatcttcaatcccaagcaaagttaaagtattatttttaccttctgttgcatccttatgagtagcttttcccgcttcagttgctgtctccactacatctaccaaatcatcatagatttgataagatcttccaaaacgcttgctgaagttgtctaatctattaagctcagaatcagttgcaccagcataaattgcagccattttaacacttgcttcaattaggcagcctgttttcaaccactccatctgatcaatcatcttagcattttctttagctgaatcgttattagttgtatcaatatcaagatattgaccaccgaccattccatttggtcctacagcttgagaaataacaattgctaacgcagctgaattactcccctcggtgatccattgaattcccaacggaagcaacccatctccagctaatatagcttctgcttctccccattttttatgagaagtaagttttccgcgacgataatcatcattatccatcgcgggtaaatcatcatgaattagagaataagtatgaattaattcaattccacatgcaattcttaattctggctcttcaattttatgatttagtgtctcaagagttgctaagaaaagcaaaggacgtagtcgcttacctcccgccattactgaataagacataattttactaaaagttggattatcaatttcagtaaccagatgttcttttaagaaattgtcaatttgaggtgtatatttttcttgaaaatcttttaacttcatttattcttcctcaggagcagacgcattttggggatctaaagccttttcgttcccatctttatctactaacttggccacagtttgttctgcatcatttagctttttctctaattctcggcttaatttaactcctgcttgaaattcacttaaagcatcttcaagaggaacattaccactttcaagcttattaactatttcttgtaattcatttaactgttcttcaaaattatttttcttgattgccatttttttctctccgaatattttctacatttacttgcacttgaccatctttaaaatgtaactttaacttctcatcaatttttagctggtcaactgaagtaactatatttcctttttgatcagttgtataaacgtatcctcgactaattgttttcaacggactaatatcatctaattgttgcatagctcgatttaatctatttctttgatctttaagatagttattcatcgttgaaaataaattcgatactacaaaatttcgttcacgctcaagttgctctaattttcggctaggactgagtgccttaagacgctcttgaagtaaacgtaatgtagatccatcgtgctgtagtcgattgtccattgcctgattaagacgatggatgagcatatcaacttgttgaatttgttgatcataaattctagttggctcttgtaaaactggtgcgttctttaaccgatctaaaatttgatgctttgtatgaatattggcctgaacggcagcataaagtcttgctcgtaattgaacaatttgcgttagtacatcaactaaattaggagttgcatattctgctgcagcagttggagtagctgctctagcatcggccactaaatcagctaaagttgtatcagtttcatgtcctactgaactgatcactggcatctgcatcgcataaatctgccgcacaactttttcttcattaaatggccataaatcttctagtgatccaccgccacgcccaatgattacaacatcatatttatcgccttgagcttgaatttgctgtaaagcagccacaattgtatctgctgcttcatctccttgaactttagcgggatacaaatcaatctcagcatgaggaaaacggcgattagcagtaaccataatatcatgaattaccgctcctgaagcactagttacaactgcaatacgatctggaaatagggggatcttctttttatgttcttcattaaataatccctcctttgcaagcttctcttgcaattgtcttaactgttcataaagagctcctaaacctgctggctccatagtctgagcataaaattggtaagatccctgtggtccataaacatctacatatccactaacataaaccttcattccctcttcaggcttaaattttaatttttcaaaaaatgagcgaaacatcactacattaatttttgatttttcatcttttaatgaaaaatactggtgggaattcattctaaatctaaagttagacaattctccctgtaaaaacactttatgtaaatagggatcatttttaaacttttgtgaaatataaaaatttaaatcactaacagaaagataaactttattatctaccatgttgtttcctcgtcaaaattacggcttgtttcattaaactggcaactgttaagggacctactcctccgggtaccggtgtaattgctttagctttcggagcaaccatatcgaagtcgacatctcccattaatttaccattctcacggttcatcccaacatcgattataactgctccctcttttaccatatcctcagttactaaatgtgctttacccacatccgaaataatcacatcagcatttttagttagctctgataaattttttgtttttgaatgggcaatcgtaacagttgcatcccgttcaactaaaactgcagctaagggctttcctacaattacgctacgaccaataattactgtatttttaccggccatctcaattccataatagtcaattaaggttaaaatactgcgaactgttgctggaattacatcactctgtccttcccagagacgccctaaattaagaggtgaaaatccatcggcatctttttctggggcaattgtttcaaaaatagcccttggatcaatttgaggaggaacgggcaattgcaccattattccattaatacttggatcttgattaaggtcttcaattttttctagaagttcagcttgagaagtattagcgggaaaatgcagtcctatttccttaattcctacttttttagctaagtttcttttaactcgcaaataaattttgcttgccggatcatctccaacttctattacgcataaagttggatttattccgtcactttttaatttttttatttcttctatcaagttctctttaatttcatttgcaggagtttttccttctagtaattttttcacttaatcacctcataaaaaaagtcggctcaacgagccgactcattagttagtctttcttaatgaaattggccaagagaccattaataaactttttagattccttagagctaaattcatcacataaatttaacgcttcatttaaagcagctaccggatcaattactttgctattttgcatttcataaagagctacttcaaggattgccaagtcaatttcgttaattctattaagacgccaacccttttttaaatatttacttaattgctcatcaagtgcttctttatttgctaaaacaccattaactagttctgtagaatagtctgggaaatctttcaattctaaagcctttaaagctttttgacaaacttcctctgcatcagttaatttaccttggttagccaaataaattgcttgcatagcaattcttctcatctcatgctgtgtcatttagtctttagcctcgtcctctttatcatctgggaaaagtgcttccgtgtcagcctttacttcagtttcgtctgcttctgaaaccaagccaactacatgaacattaatttgagttaaatctaaatctgtcatttgcttcaattgcaaagttagatttttttgcagttggacgcatacttttggcacatttacaccgtagtcaagataagtataaacatcagcagttaacttatcgtcttcaacacttagggaaacacctttaccttggttagaacgaccaaaaagagtatcgatgccagtttttagcgtcccacgcatttcgctgacgccatcgacttttctggcagcaattcctagaataacctctaaaacaccaaggtcaactcgggtttcatcgcctttgtcattgcttgataaaagaatcgttgaattatcagccatattttttacctcaaaaactatttatttgcacgagaaacgtaagtaccatcagcagtattaatagttaatacatcaccttgattaataaagaatggtacgttaactactaagccagtttccatagttgcgggcttaccaccaccggaagatgtatcacccttaatattaggttcagtttctgcaacttcaagatcaactgtatttggtaaatcaacacccaaagtttcaccctcatgagtaataacgttaactaccatgttttctttcaagaacttagattctctttcaacttgagcttccggaatttcaagttgttcataagtattagtatccataaatacaaaacttgtaccatcattgtataagtattgcattgccttagtttgaatatcagcagtatttactttagcagttgaacggaaagtatattcttgaactgcaccagttcttaaactcttaagttttgaacgaacaaaggcactacctttacctggcttaacgtgttggaattcaacaatacgccataaatcattgttatattcaatagttaatccatttttaaattcattaactgagatcattgtcatagtaaaattacctcatttctacacttatttatattaccaatcttatctattgtttcgcaacattaaccgcataattacacaaaattataagattaaaagttcatcttttggcaactgtgacatcacatatggatgattatctttaattaaaacatcatcttcaattctaacaccgccacggtctggcaaataaattcctggctcaaccgtgattgccatattatttttcataacttctttactatatggcattgctggcgtacagagttcatgcacttctaagccaattccatgaccaataccgtgaccaaagtactctccatatccttgctctttaatgtagtttctaccagcttgatcgatatctttaccagtatttccagcaattgcagctgcaattccccgtttttgtgcttctagtacaatataatatattttttctagttcaggctctacttggcctaaagcaactgttctagtaatatctgcggtataaccatgataaaaacttccaaagtcaattacaattaattcacctttttgaatctttttatcactcgcaacaccatgagcccaactaccgcggtatccggaagcaattattgtctcaaacgaagggccatctccaccattcattttgaacaaataatctaattttgctccaatagcacgctcactaacaccgggctcaattaaaggcaaaatttctttaaaactttgagctgaaatatcaattgccttttgcaaagtttctaattctagctcatcttttatgttacgaactgtttctactaattcagcatttaaaataaaattaagatcaggacaagcctgcttaagagcctcaaattgagttgcagaaataaattctccttcaactagaacagttttaacatctagctgctttagttggccggcaatttcttttatcacgtccatagtttgcataactaccttcatttcgccaggtgcctgatggcgaatttgatctttgaaacgtgaatcagataataaaacgcgatctccatttgcagttaaaataagttcagcttcttcaccagaaaaattggttaaaaagcgataattagcttgattaaaaatgactaacgcatctgcttgcttttctttaatcaatttagtagttttactaattcgattattaagtaacgttaataactcttgatctgaagacataggcttggatcctcctgagtagataaaaaaagactgaacgttccttagggacgtccagcctgcaaaagaaaattattttgcttcttcaactgggtaaacagaaacttgtttacgatctctgcccaaacgttcgaatttaacaacgccactagttaaagcaaacaaagtgtcgtcaccaccaataccaacgttcttacctgggtggatcttagtaccgcgttgacggaaaataattgaacctgcattgatcttttgaccatcagcacgctttgcgcctaaacgacgaccagctgagttacgaccgttagcagttgaaccaccacccttgtggtgggcaaataatttaagtgcttcaagattattaatcatcataatttgtttcaccccttaattaagcttcaatgctttcgatagttaccttagtgtaaggttgacggtgaccatacttagtgtgtgagtgcttcttaggcttgtacttgaaagtaacaactttcttttctttgccttgcttttcaactttagcaacaactttagcaccttcaactactggagtaccaatcttagttgatttaccatcatttacaagaataacttcatcaaaagttacttcgtcaccaggcttaacttcaagtttttcaacaaaaacgctgtcgcccttagcaaccttgtattgcttaccaccggttttaataactgcgtacatttgtacacctccgaaaaaatacttagactcgccgcatgaggtggaattaacgttaattctcttctaacctcataaacgtgcggttgcagatgtgaggtttccacaaatacaactcttacagtatactctcatccctcttttaaagcaattcaatatcaaaatttctaaaaaaataatagaatattagtaaagatttttaagaaggagtacagtatgatcaaattttacggatacaaacgttgttccacctctaaaaaagcgcaaaaatggctagatcaacaccatattgcatatgagtatcacgatttagtagaaaagccacctaaacaagaagacttgcttaagtggctaaataagtttcaagatagaggtttaagatatttctttaatacatcgggaaaagtctaccgtcaaatgcatttaaaagatcaaatcaattccatgtcaattgaggaagctgccacattactttcacagaacggcaaattaattaagagaccgttaataactgacggtgataaactaacttgtagcttcaaagaaaatatatacgaaaaagtctggctataatccccattgacctccatgaacccgcgctactgtatcagtaataataaaagcgtcagggtcaatttcatgaattttactgattaaaggaccatattcacgcgtgtcaactactaaaagcaattgttttttgtcatcatcactatagccaccaacaacatcataaattgtcaaaccattataattatctagtaacatagttttcaattcattgaaatgtttattactcataatacgaacttgatattttcgatcaaagcctgcttctgcatagttcatcgtcatagatgtaactacctgagacaaagccgctagtaaaaaggcattccatccatcaacaaatatatttaggaaaataattatcatatcaattccaagtaagccaaccgctggattgatataaaaatattttttcaaaatcattggtggaattgttgtcccgccacttgaagcatttacacgatagagaagagagactcctagtcccattaatactccaccgtaaattacagcaagtaattggttattagtaattttaaaacttggggtaatttccatcaggattggcaataataaactacctaaggcaacgttcttcgttgtcttttttcctaaaaaaatggctgctaaaaccaacattaaaatattaacaactaaaaccgttattgaacggttaattccccatactgcgtcaactaaaatcgaaataccagttgatcctcccgcagcaatattaattggaccatagaagaaattaatagaaatggcgataatttctaggccggctaaaaatactacccagcgcatccaagatttctttttaatgttttttgtcatttcatcatccttcctaaaaataagttattaatattttatctaatttctatacaggttgtcagtttcatctcccattcctaattattttttaacattttatattctaattgctggtttccttcataagccggcatgccattttctgctctatacaaagcgcgttcaaatgcttgatatcctttgctggaactaacagcaaattttacatgatatttgcttgcaaactctctaatattccaagtactgtcatgagctgcaaaagctgttaccaagattacaatatctaaatctttaatttgattttcaattacctttttctttccctcaaaagcatcaattggaattgcaataccattgtagcgattaacaataccttctaaaattgcttcgttttgattgtctccaactgcaatcccaactctttgataatgcaaattcatatctaattgtgtcagtttctgcgtattttctcgacttgacttttcttttttagttttagaaatccgttttggttgctcagtttcatagatccatcgaatttgaacggcactagctggatctttcttaagtcttacatcaccggtataccaagccaagtcaacaatcgaaccatcttctaaatgtacacttccattttgatagtaactagaatcaagggcaacaatcaccggcttatgattaattgttaacctttctccgtgaatattacgcgaaacgcttagatttcccggacttccttgtactacaccatacttaaaatcttctattcttgtcataatcacggctgcgcaattttctatagccgacaactcgtaaaacttcagcttcatttaaactatctgataccgggatagattcaacaatatcaccactctttaggtttaaatcgtgtatttgaccttcattaacctcaaaaactacttctccattatcattgattagatctgcacccttcaatgcacgaataactgtataacgtcttcccttgcgatagtcacgtactttttcttttttaggctttaatgcttcttcaaaaatttttctatttactacactactcgtttcttcggatgattgaattgcttgatcaagctgccctagttgttttccaaaattagcagtaatattttgatcaaaagttaatttatgtagtgcgcctaaagctgtctttttagcatctttattgccaggatgctcaattaatttagttattccttgcaaaaaagtatttatttgggcaataatttttggatcaagttcaccgccagttaccctttcactgctttcccctgtcattcccaggactaacttaattgcattcaagctatttttaaggctcttttcgtcgccttctgtactatttaatattctttttaaattatttcgatagtcaaacattttaaccactttcttacttactttttatctattatagcgatttaataatattcaattcaaaatttctttatcaattctatcaataaagtgatatattaaaggtaaaaaataaaaagtgaggaaaaatcatgactaagtacactgttaaattatctgaagaagattaccaaatgttaaaagattgtcattcaaagaatccttcaatcatgaaggctttagaagaagccaaaaaagaagattagactaaacaaaaaaatcgtaattagttaattgctaatcacgattttttatttattttttggacgctcttcgactaaaaagcaacattccaactaaagtacctataattaagtcaataattactggaataatcataaactttcctgaattaaccataaacatatcaagagctgcccaaattattccaaccaggattcctttatacagatactcccacttaaacttaaattttggttgatctacgctcagccaaacaccagctaaaataaaacctaaaaataagcttataacgataagaattacaaacagactaattactctagcagttggtaaggtgcgtaggtttgaaaaatcagttagactttcaaacctaaaaaataaaagataaacaaaccagacggtactaaaaattaatcccagttttattaagcgattaatagaaaactttttcaatttttaagccctccattcgccaccttgaccataagtatgtttatcaagttcattaataattacatgaatatgttcttttggagcaccagtattcttatgaacagcttcggtgatatctttcatcatttgagtaagttgttcatcacttctacccttaattagctctacatgtacaaatggcatttaaaattcctcctttttatctttaatcaaaattataacaaatctattttaattaagcagtccttcttaaaattctccttgcaccatcacggactgcaaagtataagattggagtacaaattgctgtcgaaatcgaattgatgatcgttgccggcaaactaacaaaagagctaactaaagccacatttaaactagttcctaccattaaagcttctacaattgagacacagtaagtagtaaaaattttcgtaaatccagcaataattcctaaaataataatatttttcttactatcttgatagtgcatccccttatatactgccgttaaaacacttgcaactactacgacttctagcattgttaaccacgaagttgcagcgtaaccattaagcaagtcaaagccgcccaatccaataatcccagctagcattccattacgataacctaaatataaaattgcaacagccgttaacgtattaccaaaatgaataaatggacgccctactaaagcaggaactgggattcttaaaacccaaacacccaaataaattattgccgcaaataatccagtcataattattgaaactaatgaattttctcttgtgcgcatttattatttctttccttccactttgttcattaaccaagatagggcacctgcgtagttaggtcccaagcgtttatcttgtcttaggtcagtcttttcaatcgccaatttaacaaaatcacctgctatttgtgcactttcttttaaggaatatctagctaaaaaaactgctaataagctacttgcaaacatatctccagtgccaaaaaatgagcgagtaattttttcattttctattacgaaaatttcactatcgtttgctaataccaccatcttcactttattttctaagaaaatgccagtaattaccagaccatctaactcaaacttttcttttaactcgccagcaatttctttaatttcatttattgaaaaatttctatattccttattcagtaatagacatgcttcagttaaatttggagttaaaatagtcgcgcgctttgcaagttcgcgcattttttctacatattctatatctaagccgctatataactttcctgaatctgccattgctggatcaagcagtattaataagtcagtatttctaaaatcagaaatatgctcaatccaaaaatcaatggcatttcttcccaaatagcctaagtataaatttttaaaagtaattttttcatcttgccagtgagcaataattttactcatttcattatttagcgccaaaaaggtattattaccaaatccaccagtatgagtagataaaattgctgttggtaaaacatctggctgatatccacatgcacctaaaattggtaaggcaacgcttagagagacctgcccaagacaagacaaatcttgactaattaaaagtttttccttcattttatttttctttctaacttaagtcgttttttcttaataccatatcgcttcgaatttaactcagcttgtaataacttattatgccaataaattaaggctactttaattgctaaacgattataccaacaataatcatgctttaaataattaaatgaatctttaagatccagtaagtgctctgctgtaacaaattgatttcgactccagtgccagtccgctgcaccattttttcgaattctaattttttcaatccggccaaccgttaatcttgctcgtcccctaatatacttactccgagctacagtaatataattaccaatcatcgtttttttccagaattgattatgtttcttttcgataaaaagagctcgtcttaatactttacttagacaataccattctttattaccatttgagagttcgattaaacaccaaatatattcatgtcttttttgcaaattttccccaacttttttacttaacttaatttttcatataaaggaattaaatcattgattccttctataataaatttctccatattatcaacattatcatgatcacgaaaggcaaactttcctagtaaaaagctacttttgatagcctcctgatcaaattgagttttcttttcataatcgctcagatattctgctaaagctaaatgattgctgaattccatttcatttttatcccacaaataccagtttgaaatatctaaactagaaccccactttgaaatatcagttaaaagcgtattgtattcactcacagttccctgacgcttatcactcttataatattgaaacatcaaataaacttgtaattgcttcttatcaagcatgacgccaatacaaggattatagtctgctaaggaagttaagcgataactggcccaaaaatgatctcttaaattccacccattagtccagctttcaacatgaacttttgcaaattttcctgtcggtagttgttctgccacatttaattgaactgttttccaaatttgccagacgcctttaaattcttgtttaattgtatctatttcttctggtgttttattaacttttaattttttaaaagaaaattcttcttggtcaaatatctcatacattttattagttaaaactgtcattcttttctcctataatcaatctttaaaaggcacctcctccgctgccaccaccaaagccacctgatgaaccgcctgaaaatacgccagatccaccagaagcagaagaatttaagttagcacctgagtcaaagctagaactaaagttacttgcaaaaccatctttcccatcactgtaaaaagcaccccagaataatagatttgtatcgtcaatttcatctgcaaattctagtttcaattgttttaatacttttttagatacaccaagagcaacggcatatggcattatttcttcccacaagatcagttctccaatatcacgcatcttgaaattaccaatttcatctagcattttcttaaatccgcgaacttgattagttacctctgctcctcttgctgtataagctgataattttttcttattataaacaactgccaaaattgccagtactaataaaattgcagcacatataaacaaagcaatattttcctcattcgaaaagaaggcgctgaacattgcaataccactcaagattagtaaagtcaccatcaaaattgaattagcgtgttgtttatgctcaagcttttcatcaaaaaatcctgctctagttgctttctgcatttcttgttcttgccacttattgaacttctttcccaacttagaggagtggtgttttttaagttcgtatgttgtaaaactcttgccatcgcctactttatcaaataagtaattcaacaaaggtttattttttattatatttttatcaattaaagaaattttgtagtacgttctttttcttatcttgataggatcaatcttaatctttttttggaccgctaattccattagagatgcagttaaagacctagagcttggctcatctcctgtatctaaaatttcagccattaccggtgagactgatggaatctcataattcctagccagttgcttttctttttccggtttaactccggacttttttaaagtaaagcttctaataattgctagtaaagaaaatagcccagatattaccaaagcacctaagcctaggattctgtttctttgacgccgttcattagcttgtcgtgcaaatcttgcttcttgatctaaaacatattctttatgattttgatctttaatattcttattttgattagttacctcaacaggaaacagactatggacctcaattccttcatttccacctacattagaagctgtcatgataatattgcctttttgcggattaactgtaatttggccagacaagtctccatgcgcccaagcttttaagtctttaactgggcccgggaagaaaatacctactcgtacattatctaggtctgtatcccatccatctccaataatcttaaaattaagttcagctgtatctttccagttcgtgattgcatttgtaatttcataagtataaattactgtaaatttatctccatcccttacgctatgccaaactttaaaacgatagccatgatcactatgacttaattcataagtattattttcataagtcgcacttggtactaccatttgtgaatttttgtcagccagaattctaacctgcggattttttaactcttgattattggctaaattttgctgatagaaaataccatgagcgtcatcatcaaatttataggttatccttctctccatagataatgaaccatttggattaactcgggctgtcacatcaacatttgtaatatcataattcacatcggccaagactggtttggtaaaggccataactgaaattaaaaaaagaatcatttcagtcattacataaaaaaattttttcatagaatcctctaacaaaaaaagtgagtttttgcttaattataacttaatacacgaaaaaagcactagattttattctagcactttaatagcaattcaatttaagcggtaactttttgttttttatgaatatattaatagggcaacaacgattccaatatttgaaattatcgatagcattttaactatagccttttctactactcttttacaatatgtcttctaaaaaatgctgcttcttcgtcattagcttccttcgctaattcatctttttgattaattagaaaaacatgcggttcgggatgcttttcatcaccccaagatttttgaataacttctatgcctttagcccttaaaaatccatctaatcgtactgcacaatcatgaataaagtcttcattagctgttgaaatgaaggtaggcaaaaagcctccagtaatatatttttcaacatcaattaagtcctgattcttagcactcttcattacttctggatcaaagtaagccaacgtagcgtccatcatcatccctggatccttcataaaagtagctggtgagtttaaagcaactgctctaaacttcaaatcagggagggtatagccaaatttttctcgatataccggattagtcaaaatcgctgtgtattgttcagccatttgaccaccggcagaatccccaactaagaaaacattgtttttatcaagattatattcatctgcatgttttgctacccagtgaatatattcattgacttgatttaattcttctggaaactttacttctggtcccaacttatagttaggatttataaaagcaaagcctcgtttagccattcctagtccataaaattgataggtttctttagtaccgtaaacccaaccacctccatgaatattaatgataacgggaatttttccttcaatatttttcggtaaatatatatctaataaattccatttagaatcgttaccatattgaatatcatctacacgctttatctccggaagatcatggggtaacccactatctcttttatcatcgttcttcttccagtcaatacgcattttttcaacagcttctaaaatatcttgttctttcataatcgtttcctctcttaatgaatttgcttttttattttggatgcactttcaccatacaatttattaaaggctcgattcatcattctaatactcgaaaatccattattaattgcaatttgggtcagattattctttgaatgttttaactcatgataagcatgctcagccctgacattattaatataggtttctactgttagttccatttctttcttaaaaaaacgagctaaatattctttagaaatattacattgattagcaatcaccgttaaatttaattcttcttgataatgattattaacgtattgagtaatatattgcaatcgattaatgatataaatctttcttccactgatacgttgctgatcgcttttctcttcggtaaaatcacttaaaagtaaacacaaaatttcatcaattaacctttgctgttctaaatatttagtaggaatatcgagaaaataaactttgataaattgaccaagtaaactttgtaatctaaggtaagagattttctgtttactatcaaatttagttggatcattaattttaataatttgatgggcaatcgaaggatacagaatttataacataatcatagggaaaaataattgacaaagctaatgcattatcgttttcaaaatcatgaatactatgtatttcttgagtattaactattaaaattgttccggactccgaggaatagtgttccttattaattaaaaaatcagctattctcccatgctcaacataacttaattcaatcccgcgatgccaatgcggagcaatatatttttcagagttatgatcatgaaaaataaaataccaaaccggtaagggatctgtaggaacaactatttcatgttgctttatttttttaccatatgtcattatagtttttcaccatttacatgtataaaaagattatacaaagcaccatagaggttagctccattcttaaatttagcctctatgattttcggccgagtaaaagtttctctaattaatgtattaccagctaaaaccttatcatatgcttggttaattccttctacaacaataggctgtgcagaaataccgccgccaatggcaatcgcatctaaatcaacaactgcttgaatatcaataataatggtagctattctcttgcaatattcagcaaaaatttttctagcctcttctttccccctattaatagcttcaaaagctgctaaaccatccatttcatcttcattattaattgcacggtttaccctttttatcatttgaactgcagaagcataaccgccggcaaacccattaaaacctgcttcgttcatattaagttgcaaaaagcttaattctcctgcctgaaagtgtgctccatttaaaagttgtccatttacaattattcctccttcaactcctgttcctaaggtaattgcggcacaattcttcatgtcttttaaacttccaagccaattttcagccaatgcactagccttaccatcattaattactgcaactggaatattgtatttttgatacctttcggcaaaatcaattccatcaaggaagggtaaagtcccatcaaaatgaatttttgtatgggcaatctttcctggggcacaaaatgccaatccctttactccctttttgatatatttttctacaatctgatcaatattttccagaaactaatcctttttttgagaagtctttatttttccttcttcaataatatgtcctccattgtccaattctgcatattttacatttgttcccccaatatcaatacttagatagttctttttcatttttatcctctccctaaatgtttagcgcttacattaaacattttatggtgtattttcatctaaaacaagccgattattgatattttttattccaaagattgatacacgagcaactaattcattgcaagacaaaaggcttacttttgaataaaatcaaaaaattgaattttttcttttcttataagaactatgttttagcttggattataaaattcttcctcttaaggaaagtttttacagaagaacctacttttgaaaatttatatgtctttcttaacgtagctctaaccaaaattcgttttttattatcatttgtacaagtcaacatagttaaaaaattactcttagaattaagtgctagattgacctgagttggaaagataatatgaactgattctattttatattcttttactaacttaaaatcagtaataaaaacctccctatcaatcagtttattatttgcaagtggtgaaaataacgccttactaaacgatccgaggttgtgtgccccaataataatatttgaattactatctatttttcttttgactaacatccctgcaccaaattgataaacagcatcatttgtattttctgctaccggaacctccatatttaaactaggaacaataagaacttcctgatatttaatatcatttatcataagtaacatatggtaattttttagtggtataaaccgatttttcatgcaatactttacgttgaagatcgttaccaaaattaatagcgaaagatataagaataattaggatacttcctaagtaccaaagttttttatgtttcataaagttttctccctataacctctattagttgatttcccaagaatcatagcaagctattagtaataaattatattttttacttaaatacatacacgaagtaaacgtggtaaacatcatatgccaaacttacatctacagacaatttaatttgacaatgtctttctccaaaattagctttattgatggaattaagaaacaggaaggcaagttaatatatagatataagaattaatagtgctttagaacaaattcaatattggtctatttgagacaatgaaagcaattccttttagaaaacttacaaaccgtgatataataaaaaatcctcatgttagctctcgaacattctatcgatattttaaggatgaaaacgacttgctagagaaggttaaggacaatcttatttatgagcttatgtttttttaaaaaagggatcgtaaaatgctagaaaaaataagcttctgaacatagacgcaaatagttatcatcatactttaacgttttgtgcaaagaagcgaaaagaaattctccttcttctttcccaaaatggagatattggttttctaattaaaataaaaaatttgggaagagaagaacttaaaaaagatttgaattaacaaatcgaaaaatcgaaaataatttttatctagacaacaccgtagataagaatctaaatgtagttatcaactggcttatctattatgacaatctttcaaaaaacaatattagcaaattattagctcaatccagtctgcaaaatctttaaactttacgtaaacaaagtgtgtcgattataaaccgatagattgttgagtcgaagatatattttccactaagataaaaaaggtattagaggtgtgtaagaaaaatgaaaaatataattatactcaacaatgaaaaagaattaataaatcaaattcaagttttgcttgaagaagatcgaaaaagcctagaaactatcaatggtataatagctgaaacaaaaaagaagacagttaccctatcttcttactcaaatacattcaaatatttcaaaaaaaatcgtaattacattttatggttgttctacgaaaataatcaatcctggctacaaataagagaaatttttgaaaaagatcaggaaaaaaggatcaaccttatttttcaaaaaatgtgtctaggtaagacaccaatctattgtgttctcagtcaaatttgggtaaaataccagactgataaaattatagactatttaatacaacaactacgctataaatagacgccggaaaatcaaatgtacgctcttaggatgatcatttagatttcttaccctacttttacctagtaaaaagactttctttctgtaattcaataagccagaaagaaagtctttttataatttaaacttatttatttaacatatacttttgctaatcagaccaaagataagttcgatttattatagtccaatgtgttcccaaggttttaagtcaatagctggctcttcccagagtttaactaaatcgtcagacaaatatttcttatcaacaacgacatcatacacatattcttcaaaccacttctggctcatttcgtagaatcctttatggccatacttatcaccccaagaattttctactttccatttgcgaatttcgccattatcttcatctacaccgactaaggtcatatcatgggttgcagctccttcaccagtagctaaacgatctgctttactcatttgagtatcaacactaaatagatcatccgttttgtataattcagtatcaagaaaaccagtcttacgttccatctgctttaaaacgtcatttccaaaaataactgcttttccatcttttaattgtgctgcagctgctcttgctaacacttcaattggtacatttaggccagtaatcggagtaccaccagccacattatcgtataaaccttggtgatagcgtttgttgtaatcataattaggtgaattcaataaaacaacgtaatcatcccaattaaagtcttttaaatatttttcagcaaattgacgtggcgttaaatccttttctaaatgatatttcttatcgtcgtctcggtactctaaatcaaatttcttaggtggctcacccaaagcaactgctgccattcggtaaacctcatttaaaaattccctcttagctttttcagcttcttctagcttaccttcttgaactaatttacgaagtaccaaagcatcttttctttctttacgagctaaggaatcgattaaagcactagtattatttgaagttgcattttctggcattgcatatgatggaacaacaccatattttttaaccagattaatagccatttgccacaatccaccatcttgacctgcaaagtcaaaccaagtttcgacttcacgatcatcaattggtttatcagctaagcgaatcatactatcataaaaagcatttgctctctcaatcttatcccaaaagaaattataagcttgtgagaaagtaaaatctttaacatgatacttttggccaaaatgatgacgcaaaacatttaaagtagcaaattcccaacaacgtccagaatgcttttgatcagtaactccaccgatatctaattcagttgaaaaagtgtgatttaatcgctttgaaacttcatcattaaatgatgcttcaaataatccacttcgacgtgcagctctagaagcaattttatttttatcatttttgttaaagtctgcagaaaaagccgctaattcttgttcagataaggcacccattatatctctccttttgtcttcatcaatttaattaattttaatcttacattaatatagaaaataagcaagttttataacaaaaaagactaagtattcttaaatacctagtctctttattaaataatttaaaatgtagacagaaaaatatcttttctataattattcaaaaatttcatcaatatcaagtactactacaaatgcgtttggcgtatcggtaccagaaacaatcttctttgcatattcatcatcttcatgaacatgtggcgtagccaaaacttgaacagcagtatgggatggtacatcagctgctactaatgctacttttgaaccatttttaatattttcaaaagctgcacctttagttttttcaagatattgcatatgagatgggtctaatactgtcattgaacctttaggaccaacttgtggattgccattttcatcaacagtagcaatgtaaactaaattgttcttaaaaaggtcagcttgtttatcagttaatttatttgtgtttaattttttcatagtatatagttcctttctactactaatcaattataagtataggcctatttaataaaaaaatcttcttttttgctcaaatttttataatatttaattaaattaaataacatttataccaaatatcaatctatataaatagctttttcttttttattgtcttattaatgagtcaaatttaataacatttagcttatatgaaatcgttttatttttcattaacatcaggaattttttattccttatccatcttgataagcctcattaagctataaataaaaaattatattaaaaataagaaaaatataatttaatgttgacttattttcaaaacggcgtaatattatggtcacaaacattattatcaaacagctttgataaggaaaagtaattaggaaatcgtctttcagagaatttctggttggtgtgaagaaatagatagattcttaatgaaaatcacctttgagcgtaaactacgatttagagtggtttaagggacagccctttatagcgacggcgtatcgttctcctgtattgaaccgtacgttaattaaagactagttttctagtaaaaataggtggtacagcgacaagacgccctattggatcaaattgatctaatagggcgtctttttgttttcttaatcatgctgttagtggatttttgacgaaaggagattttatatgaagatgtcaaagtccaaactgctgtatgtaactctcgcaagctctcttacgatattcgcaactgcttgtggtgctaagaaaactgattccagtaatcagacaatcaagttttctcagaatgtccccaagaaagccattaaaaaaggtggcactcttacctatgcactagaaaacgaatcaccttttactggaatttttctctcagaaattgctgataccagtccagatgtagaggctgccgctccgggagacgagtcactgttttcaatcaatgatcaatatcaaattactgataaaggagctgccacgttaaaattaaatcatcacgataatacagctaaaatcaaggtaaaggacaaagttcgctggtcagatggtaaaccagtagttgccaaagatctagagtactcttatgaaattcttgccaatcctaaggttcaaactactcaatatacttcttcattagaaaatattaaaggtatggctgaatatcatcaaggaaaagccaaagaaatttctggaattgaaatgccagatggtcctaacgggaagacattaattcttcatttcaaagaattaaaaccagcaatgctaaatgctgctagtggtttttactgggaacatgccgctccttatcactatttgaaaaaagtaccattcgaaaaattagtatctagtgatcaagttagaaagcatcccctctactttggtccttacaagatggataagacagttcagggtcaatcaactagctggtctagaaatccgtattattggcgtggaaaacctaattttgctcatatctacatgtcaaatattactaattcaaatgtttcccaagcaatcaaaagccacaaatttgatgtagccagtgttttagactctcaatggctgcaagtcaaaaatactaagggagttaatttcgttggcaaaaagactctcagctacaactacctagcctttaaagttggtaaatgggatcaaaaactaggaaaaaatgtagaaaatcctcatgccaaaatgaataaccccgccttaagaaaagcaatggcttatgctatgaatgtagatgttattaataatcgtttttatcatggcttaaaattcagagttaattcactaattccttcacaatttacgccatattacgataaaaacattccaacttattcttataacttaaataaagctaatgaattattagataaagctggctacaaaaaagctcctggtgccctttacagacgtcagcctaacggtaagcctttagtaattaatatagctgtgcgtggatcaggcgaaaacagcgaggcgatctggcgcaactatatccagcaatggaaaaaagccggcctaaacgttaagtttcttggcggtcgcccaatggaatttaatcgctgggttgccgcagttaaatctagtgatccaaaaattgatgtacttgaaggaagctggggcgctgccggtgacccttctccaagcgtattttatggtgaaaaaatgccatataactttgcccgctttgtgtctccaactaatactaaacttttagatgaaattgattctgccaaatcttttgataaaaattatcgagtacaaaaattccatgaatggcaaagatggatgtacaataaagcttacgtcgttccaactagtggagcttactcggttactgcagttaacagtaaggttacgggatggtcattaaaaccatctgctaatgtttggtatgaagctggctttagcaaataattcataaatcacaactaatcaacatatataactttaatatcgacttgtcctaaaaatgaagtatctataaatggatacttcattttttatttatcaatttttagatatcgaccatgctcatcgactacgcctttaaaatgatacttttgaccatcttgcactaaaagttctcccaagtcgatctcaccgtaggctttatctgcatccgtaatagttacatcattaaaagtgtgttcaaaaaaatttctcacaattttactttttactttaatatcttttgagcgctcaaaggctgcagataaagtaaatccctgatcaagttgagttttaataaaaataattaaatataaagttgaaagagtatatcttctaactccactttgattatcatcgaccggcttaatatatcccttttcttcccaataccgtaactgtctttgcgaaacaccaaccgttttacttacttcgcctattccgacttcaatattttgaaacacatcatgaaatatcttttttgcttccatttttttatccttaaatatcataatctcaattctagtttaaaatcttatgacagttttagcaacatatatgtcaaagataattacatgtttgtaagattatttgacaatcattttctttaagattatagtttttatagttaaattttaatattaataacttagaaaggatcttcaaaatggataaacaacccaccgatattcatggaaagtcctataatcgaaacttactggtattagttttaattattggttctttctgtactgtgttaaacgggacattgcttgctactgctctaccttcaataatgcgttcctttcatatcagcactgcaactgctgaatggctttcaacagcatttttgctagttaacggagtaatgatcccaatttccgcatggctaatcaatcgctttggatcaagaaaaatgtacttgagtgcaatgtctgttttctttattggaacagttatcgcagcaattgcaccgaactttggcaccctacttgctggtagaattattcaaggattaggtgttggagtcacgatgcctcttcttcaaaccattatgctttctatctttccagctaataaacgtggggctgctatgggaactgttggtattgttatcggcttagctcctgccatcggcccaactttatctggatggatcgttgataatctttcttggcgctacttatttagtattattgccccaattgctggcgtggttattatattagctttctttttaattaaagatgtactccctactaaaaaagaaaaaattgatattttatctgtaaccacttctactgttggatttgggagcttactttatggtttctccgaggccggcaacaaaggttggactaatccagaaattttaatgtttattggtgtagggatagtatttgtcatcatcttcggtcttcgtcaattgaaaatgtcagatcctttcttagatattactgtgttcaaacactttgaattttctttagctgcagcccttagtggtattacaaatttggccatggttggtatcgagatggtgctacctttatatattcaaaacttacggggagtatctgcatttcattcaggtttaatgcttttgccaggtgctctaatgattggaattatgtcaccaattacgggacgtttattcgataaatatggtgcccgcaagatggccattacgggaatgacccttttaacattaggtacaatcccatttgtatttttgactgagcaaagttcctataccatgattatcgttttatatgcaatcagaatggtcggagtagccttagttatgatgaatgttactacttctgggatgaactcattgcctttagacaagatttcacacggaactgcagtaaacaatacatttagacaagttttaagttcaattggtactgccattttagtctctgtcttaactactacgactaacaacaacatgccaagtaaagaattactgaaaactttaccacttcaatataaaaatcaagctattaatgctactttagatgggttccatgcttcatttgctatgagtattgtctttgctttaattgctttggttcttgctttcttcctcaagaaaggtaaccgtgcccgtgaaaatcaagaagaggtgaatggataatgataatcgtaattttaatcttagcagcaattttatttatttacttcaacgtcatccctggtaaaggacatactataatctcctggctttctttaactgttacatcactttgtattctggggattgttgcacatgactataatcactggggaatgaagactgagacacaaataagtaaacaaagtctcgtctcaagtgctaatcccaatcttccccttctactttatcaacctctaggtaatggtacagaaaaagtatacttatataaaactaacaatgaacaaaaaaagccaaaggctattaaacttgataaagtatcgaccgaaattaaatatagcgcgcaagccaatcttcaaatagaaaccactcgatatgtttaccgagataattttagtcgaattatgtttggagtctttagtcataataatgaactcaaacagagaaaatatatttttaccattccatcaagctggaaagtaatttcaactaaagatatgaaaaaattacaaaagcaactagaagaaaaaatgcaggcccaaaaagctgtaggccttcattaatttttatctatatcctaaaaaagaaacgtctatacggacgtttctttttttactttccttttccattttcataggcaagaattttacttgctaaggaaaattctttatctaagtcttttaaataaagatcattttcatttttaccaacattcttattaaacaagccctgcgcttgtgtatcaggaattccttcacgcattttttctatttttaaactacatactaccgttggtacatttgataatacttcgactaattttaaccataaatcatctactgtaatgtagtgcttaatataatctaaattaaataatagcttttcatctaatagatgaggtgggtataaaacactgccagcccccgtagctaataatttcatcgatggctgttcatacttttgactgcaccaattccaatcatcatatgctttaatcgatccatcatcattaaaagttatttcatgtgctcttcccgtgacaatacatttcggaaattttaagtacgttttatataattctgatagcatttctttgtagtaaataacatcatcatctactgtaacaataatatcgtcaggaaactcttgcatagcatagtaatattttttatgcggttttagatctaagggaacaaagcgatattcaattcccctatcgcgtaattcaagaagagatgatggaagatgactttctttaatatcatcagtcagataaactaaaattttatcggcttttttagtctgattaagcaaacttttaaggcaaatagatagtgtattcaacctatccccatagcttgtcaaagaaacaattatccgaggattcaatgcctttttcatactgctcatccctttcagtttaatattattaataattatctcttgatagcgttttataataaattaatatgctcattatttactatttttaagacccaatttataaacaaaacaaaaaagctacaatcatttctgattgtagctcaacatgatcttaatgaagaaaaataaattgttacacttcttaaaggagaagttttcggatcagtcatctatatcttagtccatttttcttccattgttaaatccaaatctttaatataacaaatatcggttcaagttatctaatgagcaactttctttgctttagcattaactctaattagactagcaatttgatcaatatctgcattattttgggcaataatcaggtctttgtttgaacgtggataatcaatcacttgaccatgattggcagcaaaagcttgtaaaaataatttactgcttctcccatttccctctctaaagggatgaagataatttaatctatccagtaaaaaagcatagtcaacatttgcaagttcttttttagaagacaattgttgtatcttttcgtctatttcttcaattccaaaattaatacgagaatactctaaaaactctgtctctcctttaactaattcataatctctaatttgaccagcccaatcgtaaagccaaccaaacataattttatgaatttttttcaaatcttcaacactagtgattttcttattctttctcaaaaaagccacggcccgaattcctgagcctaagtattctttttgtgctaattctgccgcatcagtaatattgagcttatttttaagcgtaccatttgggtaaagaaatttttgacgataccattcagaatccttttcggcctcattcattttcttcaccccaaatccgatcaatttcacttttaatctccttagatggattaatcgcctcatcaagtagcattaaaatatcctcttcatctggttgccaaccctctaagtgttcactttctacaacaaatctaatttgttcatacatttctggatcttcaatataaatgccttgaatcatttgattagtgtcattaattttcaaagaataaactggatcaagtaattccagtaaatctcctggtcgcatatttaaagatgacgataatgccgataaaattgtacttgaccaattatctggattctcattaagtgcatcttctaaatctttttccattaaagaattactttgtgaaatatcctttaaggttaaatgatgatttgtaagtaaaattgatatttttgataacataattgccctcgttcatttttaccttactatatttatatattttaaatcaaaattggatttttcactaaagaattacataaaaaaatagagaattagcacctttagaattcctaattctctattttaataattaatctaaattctattattcaactgtaacactcttagccaagttacgtggcttatctacatcaaggcccttatcttttgatgcataatatgcaagaagttgagctggcacaacagttaatagagcagacatataatagttaatttctggtaaaactacattgtccccttctctagcaaagtctttaccagcaatagtaacaacgttagcacctctagaaacaacttcttgaatatttccgcgcgttaaatcagctgttgcaggatcattaattaaggcaattactggggtatctttttcgataagagaaatagtaccatgctttaattcagctgctgcaaatccttcagtttgaatatatgaaacttctttaagttttaatgctccttctaaggctactgcataatcaattccgcgtccaatgtagaaagcatttcgagacttaattaggtatttatcagcaatctctttcaaactttctttactgtcaacaagttgctgcatcccttctgctgcaatacctaaatcatgctttaaattccaatctttagcttctgctttattaagtgcttcgcccaacgccttagccagaactgcttgaacagcaatttgggcagtgtatgccttagtagatgcaactgcaatttcaggaccagcttctaagagcatagtgtagtctgcttctcttgataaagttgaaccttctacattagtgattgttaaacttgggatattacgcttattaacttcttttaaaacaacacgagaatcagcggtttctcctgactgagttaagaaaataaagaatggattcttactcatcattgggaagtgataaccagcttctgaggccaaaccaacttcagttgggattccagtataatgctctaacattgtcttaccaactaaaccagcatgataactggtcccagcagcgtaaatataaatacgatctgcttttgaaatagaatcaataatttttggatcaaccttaacatcatcattttcatcaaaataagtttgagaaattttacgcattacgcttggttgttcatcaatttctttgagcatgtaaaattcgtaagttccctttgaggctgcattaggatcaatatctaatacatggggcttacgttcaacctttttaccatcaacagtttcgattgtgtaagaatctttagtaatgtcaccaacatcaccatcttgtaaatcaacaaaagttttggtttgatctaaaacagaaattgcatcagaagcaataatattaaaaccatcgccaagccctaacatcattggtgacttgtttttagcaataaaaacatgctctggttcagtatcatcaactaaaaggaaagcatatgaacccttgactaattttaaagcttctttaaacgcagaaaaaccatctaaattcttctcacgcgcaatcttactaactaattggacaactacttcagtatcagtattagagtggaactttacatcttgtaagtatttttcctttaattctgcataattttcaataacaccattatgaactaggtaaaaacgcttagtttcatcaaagtgagggtgagcattatccactgttggcttaccatgtgtagcccaacgagtatgaccaattcctactaatccttgttcatcaggagttagtttttcttttaagttagaaattctaccgactgcttttgttaaatattcgtttccatttaagtcatttaaatatatacctgcagaatcgtaaccacgatattctaagttagttaagccatttaaaataatatctcttacagattttccaacaacaccaacaattccacacataagttttctcctttggtatagttcatttaagttaaatggactatatttattttgctgttatactagcaataataaccctattaaagaaattggtcaagatgttttatctataattggtctatatcaaaagatgaaaaaattgcacaaaaaaaaagacgctccatacggagcgtcatatcagtgatttggtgctcataaaaaatatatagaaaagcttacatttttctttgcaatccatttcatctttattcatcaaatgaaatacgctactctttcacctcatttaaattaatcacttcattagccaattgttttatttcttctcttagatgatgagttaccattataaccgttgtattcttctttgataaaattgccttttcaagtttaacactagcagacttatctaatgcagaagttgcttcatctaataaataaataggtttatctcgcagaatttctctagcaaatgaaatacgttgcttctgtccacctgataattgctttccctgatcactcaatacagtatccacgccattggaaagtttagcgatcatatcttcaaggccacattcatgaatagcgttatttattttagcatcaggtatatttttgcctagagtcaagttccactttaaagaagctgaaaagatataaggatcttgttgtaaatatgatattttttcatgtaagtcattgtctgaaattgctgaatagcttatatcattcatttttatatcaccactattgtttcttagtagtcccgcaactaaattaagaatggtggacttaccggcagctgaatcacctaccaagatgtatttattattaagctggaaatctaaatttaaattttggaatagaggcttatcgtttttagaatatttgtatgaaatattgttaaattttatattacctaattctacatttttaaatatttgctcattatccttcttatcaaatcctgatttgaatttctggataatcggtttaactgatttgaactcttgccaattaaaactaataccacttaactctgcaaatatagtgccagcaaagaactgggcaccgctaatggttcctaccggagtcaaattatgcaatattagccaaccggtttgtcccaaaataatcacctgactaataaatgccaacccatttgtaatagcctgtgtgatcccagctgttttagcatattgtacggtatgctttttaacatcatctgaagacttattaattttcgttacgatagtctgaggtaaattggcaagaaaaagagtattaaatccatttagtatatcgtttattgtattgactaagcgttcattagcatgggtatattccaaggattttttagccaatatttttgagaacagatttggaacgatacccataataattgtcaaaaccaccacagtaattactagactgaaattgaagtaggctaatgttaacatgccaaagattatttcaaacacttgcctgacaatcattagaaaatcagcgataccaaaattattaattgtagttatatcattggttagccatgaactataggtagatacagtttgcttatgaaaagtagcgtaattagatcttgataattcagtagcgatatcttttctaattaacttatctacattttgtgagaatttagcttgttcaatattaaccaaacaatttactattgcgtaaacaatgtaggctaatcccattactgcaacccacataaagaattcatttgctctaaattttgcaacagcactcaaggcatttgcgctagagataccggctaaagttagaaaacctgcattaacaactattagaaataccacaaacaggaattcccattttaattttctaaaatattttaataattccatatatactccttggtttattaaattttaatttaaataataaatataaaattaaaataaatcaatattttttaacaaaaataaaataagaatcacaccataaaatctacttaaaattaatctattgatgagtaattgagaatattaagagttcaattattagaaaaattatgtcataaacgaaaacccgatagcacaaattgcactaagtggtcaaaaaagtattactttttgaaccggtaatacttttttagaattccttgtatctctttgctgtaatttaaatgcagtatatttaaagcttgttgcaaaatcactgatatagttcttttaaaaataatttcattaacttaaagagagcaacaaataaattagcttgggggtcatttgggtgtcaaataaaaaattgcacaaaaaaagacgccccatacggagcgtcatatcagtgatttgggtgagattcgaactcacgacccacggtttagaagaccgttgctctatccagctgagctaccaaaccaaattccttaacagaacatattctagtatagggaaaagagacttatatgtcaattacttttttgaatttttttgattttaatttaaattttttatctacaccatttttaagaatacaaaaataaggaacaacaactaatatttgtcattccttttactttaaatcaacttatagtgcttgcatgcattaaagatgccatctgcatcaatattagtagttacatagtctgcaatatgctttacttgctcttcgccgttccccattgcaactccaattttaacagcttttaacatttctaaatcattttccccgtcaccaaaagccattgcatctgctaaagtttgaccttgcaggtctaggtacttttcaataccagctaatttaccaccgtcttttgagatgatatctactgcgtattcattccaccaacttaatttacaattaggtaaatcattcactaaattttttaatttttctcgatctccatatgcaataaattgatagactttttctccgtggtattcaccaacgggtgcaaccttacttgaaacagctttttgagcagctacaacctcatcagttacaaaattaatataagggccttctttaccaattgtagtaattggaacagttttttctttaattaattggaccattttttcagtatccttctcatcaattggattaccaaaaatttcttttccatttccatctaaacaaagttgaccattcatcgtcaaataaccgtcaaatttcaaatctttgactggtaattttttcaattgactcatatcacggcctgtagctagcactaatttatagccattttcatgtaaaagtttaagtgccttcctagtactttctggaacgctatcagttttatgagaaactaacgtcccgtccacatcaaaaaatattgtttttaccaaatcatgtcacctctatccttcaaattatatcaaaaatgcgctttcaaaaccgaaagcgcatcttttaattatttatttttcaaattttagtcaacagctttagcaattgcagcgttaacagcagcctgttctctcttaactaagttaaccttagtttcaattaccttagtatccatcttaatttcacgagttaagcctggagtattgacctttggttcaaagaagtctttgaattgattcaatctttcttcagtatggaaaatatttgcagttacagtaataaaggttgcaaattccatatctccacctacagttgcttcaagccatggccactctaatctaatccagttccaagcttgttcttgaccaaatggattagctaaaacattacggtaccatgcacgtaagtcttgtggcttaataatttcggaattttcaaagtcatcaacaattgcatcaatgatttcaggcattttagttgaagtaataccagcacacaagtcttgcttcaaacttgcatcagaagtttcttgatacttcttaagaagtttatcaaataaggtcatgttaccaaagttcttaacctcgttaaccaaaacagcacttctaatatcagcggaaataccctctaagttatccgaattttctgaataaatagtgtgcagaccgttaattgtctcatcattaccagcatataaggaagctgcaacaacatatggtctagttaaattatcatcattagattcaccagcttttggaagtaatcctagacgcttaacttgtttttcagaaagtaaattataaagcttctttagatccttttcttccttagaatctggagttacaaaattacgtaaagtagtcataattctgtataaagcattgtttacaattggtgaagtagaatctgcaaatttaggaagaagtggaacaatgtctgcataagacatatgaccgccttctgctaataatctgaagtcttgtagtaactgtaatttatcaaccgcatctaattcatcaatgtggttcaaaatatcatcaagtaaggtcttatcatatttaacaataaagtctgaattgttgcctacatttaaacggaatggaacaccgttgtcagcaattaaatcagcatagtcaccaacaactaatttttcatccttcataatctttggaacagcagcatagtttgaatttagtggaatttgccacttacgtcctacttccttaccttcaccgataaagaattgtttttgagttaaaactaacttaccatcttcaacttttgcatttactactgggtaacctggttgttcaagccatgaatgcataatcgcaccaatgtctaagccgcttgcttctccaagcgccttccataaatcatccccagttgcattaccatatttatgagcagcaaagtagttcttcaaaccttcacgaagagcttcatctccaagtaaggcacgaaccattactaacattcttgatccctttgcataaacaatggctgagtcaaataaggcatcaatttcagctggatcattaaccataacatgaacagattgaacaccgtctgttgcatccctttggagagctgctggaacttctgaagtttggaacatttcccaaatcttccaatttggttctaaggcatcaatagccacatattccatcatattagcaaaactttcgttaagccatagattatcccaccacttcatagttactaagtctccgaaccattggtgagctaattcatgagcaataactgtagcaactaattgcttcatttctaatgaagtgttgtcaggatcaagtaataagtatgcttcacgataagttacacagccccagttttccatcgcaccagctgaaaagtcaggaagtgctacttgatatgaatgctctaatggatatggagtttcatagaaatcttcaaagaattcaattgaacgcttagcaatatctaaggcaaaatctaattcttttgcttggtgagctcttgtagcaaaaacaccaatttcaacgccagattttgtcttagtcaattttctttgcatatcaccaaagacaaaagcaactaaataactagacatacgtagagttggtttaaagtagtgaacaccatctttaaacttctcttctggttggttagaaataatactttcaccagttttttcatcaaacttaattgcaagtgcaaaagtagcttttgcttctggttcatcaacacatgggaaggcttgacgagcaaaggtggtttcaaattgtgtaccaattaattgcttcttttcaccatcaacttcgtagtaagaaggatagattcccatcattgtatcagtcaacttaccttcgaagtcaacttcaattttcatcttacctacttttccagcttcaatattaattacttcatctttatcgttgtaattaaagtcagccttcttttgatctactctaacagaggtaatctttaagtacttttgatttagcttgactaattcttcttgtgcttcaccgattacaacagtcttaccatgaaatctcttcttttcacgactaatatctaaatagatatcatagtgttccggataaaaagtttcataaaagcgttttacttctgtcatattttgacctccaatattttaacttctcaactatttattataagaaattaaaatcttacttaccagtttttggattaaattaaaaataatttaggctatcctacataatttaaaatattgtttcattcttcttttattcaattaaaactagtaaaataaaaattaagagaaaagacaaaaaaggagtgctttttataatgaaatataatcaatatggttatctaaaaacagactttgaccaaatggttaaagaactacaatctattaacttcttacctaatgattggaaagaaaatagtttttccggccttttagcaacactagttgaaaactccgttgccgaagccaaaacttatggtgcaaaagaagccaaattagcagaatttgcagttagcgatcataaaaatttaaaagattttctagctgaaaatcctaattcaatttcacgtaaccaattttataatattgccttgcaattactcggctatcatgttggctacgattatgacttaaatgatccattagcacgaatgaaggctaatgcccttccttatactgatcaagaagaaattgatcgtaatgaattagttaaagtcttctaccgcctacttaacactcgcgctaaaaatggccaaactttcattgataatatggctggcaaaggttacttcacccagttctacggtaataataaatttatgtactttaatggtaagtcactcccagtttttgatatgagtaaggttattcgtgaagtggtctacgttgaaagtgatcttgatactgatgaagatggtaaacctgatttacttcaagtcaccgtctttcgtccttaccaatcaaacaactttaagtttcctgctctctatacagcagatccgtactttggcggaattattgctaatgaaaaacgaaaccacaatgtagatgtcaatctagaagacgctactaagagtacttaccctaagtatgaagcaatgcctactgctaaagctcaaaaacctgctagtgaagatcaagccgctacagaagaagcagtacacaaagcagcctattctctaaatgaatatttattagcacgtggatttgccaatgtttatgctggtgcaattggaacacgcggttccgacggtttaagaattactggcgcaccagaagaaactgaaagtgctaaagaaattattgaatggcttcatggtgaccgcattgcctatactgacagaactagaaaacatgagacaaaagcttcatggtgtaatggaaatatcgggatgactggtcgttcataccttggtactcttcaaattgcaattgctactacaggcgtaaaaggacttaaaactgtagtgtctgaagctgcaatttcttcttggtatgattactaccgcgagcatggtttagtcattgctccagaggcttgccaaggagaagacttagatatgctagctgaaacttgccagtctaatctttgggatgcaggtgactatctaaaaatcaagcctaaatatgatgcaatgcaaaagcgtcttttagaaaaatcagaccgtgaaactggccaatattctgatttctgggaagctagaaattatcgtcatcacactgataatattaaatgttcttggatttcagttcatggtcttaatgattggaatgttaagcctaagaatgtttataaaatttggcaaaaagtttctaaattaccaatcgcacataaactattcttacaccaaggtccgcactacaacatgaataatcttctttccattgacttttctgatttaatgaacctctggttctgtcatgaattgttagacattaaaaataatgcttacaagcaatgggaagatgtaatgattcaagataatctacaaccagatatctggcatgaagaaccaacttggaataatgaattaggtaaaaaagaaatttacttcccagataagagtggcagcctcttaaaagatggcggagaagataatgataaagtttcatttacagaccaaggtggaaaaatctttaaagaagctaaaatttctgaaggaaaatggcagtacgacttcatttctggagaagaaaaatggcttgatcaacaattgcgctttgtaactgatgaattcattcatactgttatagtagttggtcgtcctaagattaaaatgagtgtttctacctctcttcctaaaggccaaatttctgtagctttagttgatctaggtactagaaaacgtctcactccaattcctaagtcatttaatgatcaaattcaagaattgggttatcgcttcggcaccgaggtaatgaaggaattcgttcctgataaagaaactaaggctaaattaattactaaaggtcacatgaatgttcaaaactatgcagatatgaaacatgccgaaaaagttgaacctggtaaattctatgacttagaatttgaactacaacctaccttctatcgcttgccagctggtgcccgattaggtttaattatctactcaaccgaccaagggatgaccaagcgtccactagaagaagaaacttatactattaatttagataagacacaattgatttttcatgagatgtaattagttgatgatactaaggcttaacttctagttaaagaaaggagtgagaccatatggaaacatcaagttcaacaatgtattggatattattttaaataataatattttaaaatttacagtatgcaaaaagcagctagtcttcaaaaaacgaaaactacctgctttttcttattttgctaatttcaaaattactgtaaagataatcatatcatctttatgactaacatgaattttcccatgaaatgtgtgaacaatctcttgtgccattgctaatccaattccaaatcctgattgcttcgaattgtgtgattcatcttctcgatagaagcgctcaaagaaatgcgaataatcttttccttttccttctttataagtattagcaacctttaagatggcatttgttcctagccttcctttagttaaggttacctgcactttcccatctttatcgcaatatttacgtgcattgtctagtaagatgttaatcagttcacttaaaacatttttctctgccttaacatataaatctggcataatcattccactatatttaagattatttttttgcattacagacttaaagctattgacattctttttaacaatttcagaaaaatccactttatttaggaccacttcaccagtttcaccagttcgagctagtgcaattaatcggttaattaaccttgttaatcgatcaacttgttccttggtgcttttattccattcataattattgcctaacatctcttccatttcggtattagcagcaataatggccaaaggagtttttaattcatgaccagcattggtaataaactcacgctgtttacgatatgttgtaataattggaccgatcgcctttttagaaaccaaaatcaataccaaggcaaaaacaatcaaagcaccaattcctaaaacaatcgataccctaactaggagagaaaaacgatgataaatcagcgattcatttaaataaacaataaacttacgaccagtctgatttttcccaacacggtaagcatactgattattaccaattgtcactacgccgtctgttgtcttatccttaaaaattctcttacttgtactaagaatttcagctcgtccaacatcataaacattgtcatcatttactatccgcggattactctgcggagtttcggcaacagtgaagtaacggtattgaaaaactgcctccggattatattcccctgctaagaaatttttattaattggatctttttgattaccaaagactggcttagcattccgcggggttaattgtccttgattgttcaccaaggctgttaaaactcgatccacttcattatgactttgagtatagctaactcctaataaagcacctaaggtgattactagtactataaacaaggctgtaatcgacattccaataaattttcaacgaaacttttggatcattttagctcacctacctaattaaggaaaaactaccacctttttcaccgacaatctgaactgagctttgaatcgactgcaacttttgtcttaagtaagaaatataaatccagactacatcttcactagcttcctcatcatctttccaaacatgtgctagtaaatctgaagttgaaaattcttttccttcattaagcattaagtaattcaaaagctgtgtttctttacttcctaaacgaatcgaattgtgactgactaactcttgttcagcaacatttaaagccaggtctcctacttcaacctcattaggtgtatattgatcgtctcgtcgctcttttgaacgtaaacgtgctagcaactctttcagtgagaatggcttagttaaataatcatcagctccgctatctaaaccagttactcgatcatcaacttctgcttttgcggttaacattaaaacataagtcttatcgccactcttgcgaatttcctttagagcagtaattccatccatgactggcatcataatatctaagataataacgtcatatgaattcttcctagcaagttcaactgcatcccgtccattaaaaacaggatccacctcataattaacactctgcattgcggctaccaaaacacgagataactgttcttcatcttctgcaagcaaaattttcattaagttaatcttcctctctaattaaatggcgcaaagtctgcatacttacatcacaagaagctaattcatcagctactcgctttaactctttaccaatcatttcgggattctttatcttatgcttatacttcatttcatgctctaaactagcccaagtatccatcgctatcgttctaagttgtacttcaacatagtagtgaccaggtgtatttcctacaatatcttcttcaggtctttcaacatctaaaatcatatggtaagaacgatacccatttggtttagcatttgtaatgtaatctttttgcttaactatttctacgtcgtcccattccttaatcaaatcgatacaggtataaatgtcatctataaaattgcaaaccacacggatacctacactatctcgattttcttttagagctgattttgggattaccggcaattcttttcgttgacatttttcaatcatactttctggccgcttaactcggccaatcaagtgttcatataggctatcgccggttttctcttgatgaagtttattttcttttctaaaatactccagcatttgattaagtaaactatctagcactggagtatagccaccataaatatccatattaaaccctctttattaatttactaatattatagcagtcgagatttttttaataactataataatgttaatttaaagaatttttgcttttcattagaaaaactaagaaaaaggcaagattccatattaataagcagatcataactcccaaaatagaatttttaactaaccataaaattaaagctccaagaataaatatagttaagagagttattgcctcaattttttcaaatcgatatgccttcttactataaacttggttcacaatcaaagagaaataataaagtacaatcgtaactacaattaacccatacaaaaacttacggtccacatttttattatttaaatatagggcatctacagtcattaacaatacagaaatcacaattgcaatatgactatacattaagacaaatcctctactaatttgatgatggttaatgatcttatcagataaaagtacatagctagcaaacattaaaactagtgataaaaataaaaatgcagcatacataaggggagtcttactattgaagtaatttgctaaattaacaattgcttctccaaacgcaataatgactatcaaactgactctctccacaaaatgagggaaattaactctttcagccttaaatttttcccataaaaagattggtaaaatcaaaccaataatataagcagcaatacagaaataaatccctacagaataaccaagtatcaaccctaaaattactaaaaagaactctgttcctaaaataaataagaattctcttttatcattaacttcattaaccgaagtgaataaatactgacaaaatattgttgcaaccattacagccatcgcaatattaaaatagtgaaaggttatgcgccattccgtattaatattgttggctaagtaaactgctgtaaacacattaaaaacaagtccggcaatgtctaaaaagttattcttggtgtatcgattaaaataaacaacctgatagagccagatttccattactacaacgacgactaataaaaactctaaaaagtagctaaaggaatacctccattaacaggatgatgaatcatcgccgtaattctagaaatcgcatatacaaaaactaaatcaaagaataattcaaacatatttaccggtttagcaactattttttcacttaaactcctcctcaaacttaattagtttctatcttgccttatattcataaaaaaatcaaaaatgcccttagtcttatccgactaagagcaaattgatagcttaattttctaattctacatatattttcacactctgtgatactgtttgataaacagttgaaacatgtagagtatggtctagaaagtcttgtttttcttcttgagacatagagctttcaaaagaaaccgtaatcaacatttcactaacaactgactttccatggccgagtttagtagtaattgcctgatttgttactttaaagttctttacatctaaatgatgtacatttgcaatcatccctgcagaaattgaaatacaagagttaacagcaccagctaaatattctactggattcggggcaacatttttaccacttgctgattcatcagccatgaatttatttttctttgttcgattttcaatttgccaaggagtatcagttaattcactttttactgtatattttgtcattttttctcttttctaaattaatccatgttttaccaaataatcatgagctactttagcaggtttctcatgcttaacattaacttgataattcatctgctgcatctcttcagtagtaattttaccagccaatttatttaaagcctttacaatttgaggatttctctctgcaaattttgccctcattaggggagctccctgatatggtgggaagaatttcttatcatcatctagcatcactaaattatacttcttaatttctgcatctgttgtatagccatcaacaacattagcttgattattagcaatagcatgatagcgaatgctcgattcagtactcttaattgaagcaaaatctaacttatagattttctttaagcccggatagccatcttttaatgaggtaaagtctggatcaaaggctgcatgtacttttttatttacacggtttaagtcactcatcttggtcaagtgattgtctttagcaaatttttgtgttgtagctaaagcataaccattctggtaagccattggcttcagatattccatatcaaattgtttctttaagtcgcttctagcttctacataaacttgatttggatcattcccggtctttttaccagttttgactaaagtttgtaaaactgtacctgtaaattcaggataaatatcaatcttatcggtttgaagagctttgaataaaaatgtggttccaccaaagttaggttttaaaactaccttagtattggggtcattcttttcgattaggtccttatacatattaatcaaaatagctggttctgatcccatttttccagcaatggtaatcgtttgttttggttcagcaacatttttagaagtattagcataatggttatacaggctacttccaccccaaattactaaagctagggcaattagtgcacttcctacttttagacgtttattattttttgaaataaatttcaaaacgccactaaatattagagcaagcaatgcagataaaattgctcccattaagacttcagtattattgtttgaattaattccaacgtatatataagtccctaagcctccgccaccaattaaagcagctaaagtggcagtaccaataatcataactagagcgatccgaattcctgctactatcattggcatagccatgggaatttctagtcgctgcaactttttccatttagtgagtccaaaggcagtagctgcttcttctagattttcgggtatttccgttaatcccgaataagtattttgaaatattggcataattgcatataaaactaatgcaatgactgctggcacagttccgattccaacaaatgggagcagtaaacctagaaccgccaaactaggaattgtttgaataattcccgctatttgaagtgtaaattcagcagcttttttgtgaccttttaaaataaaagccagcggaattgcaattaccattgcaatcagcaaggcaatcagagaaatcttaatatgaacaagcgtggtagcccaaatttgttcatgttcagttagtaacatctgccatagtgatttaatcatgtccagccacccactttaaaaagaaattccaaactctttttggctcaattaaaaattcaccaaacctggtctctgcaacaaacagagtatcaggatggttagaacaatctttaattaaatcctctacgctatcaacgtgataacgaacaagggtatccactttaggatagaatcgtggatctacgcccaattcactcttcaataaagtttcaaggtcgagcttttgattaattctatttcctgcaaaaaattcctgtacaaattttgtagcaggatgtcttaaaatttctctaggtttgccaacttgctctaaaacacctttatgcaaaattccaattgtgtttcctaaacgaatagcttcttgcatgtcatgtgttacaaacattactgtcttattaaattgttcatgtaaattaataagtaagtcttgtagttgctttcttacaactggatcaagagcagaaaaaggttcatccattaaaacaacttcaggatccgctgctaaagcccgaacaatgccaactcgttgttgttcaccacctgatagttcactcggcctgcgatcacaatataattttggatccaaatcaaccgattttaatagctcttcctgtttttttcgccgttctttgcgatcgacaccttcttgctctaacacaattgtaatattttcaccaacagttaaatttggaaacaaactagctgtttgcaatacataccctgtcttttcccttagtttacgcaaattatattcttttattggtttatcatttagaagaatttgtccctttgttggttcaataagccggttaaacatctttagcaacgttgtcttcccgctcccacttggcccaactaaaacaaaaatatctccttttttcactgcgaaagaaacatcttttaagatttcttgtccatcgtatttttttgaaatatttttatattcaatcatcattttatccttataaaaatagttatttatattttctcactatttataagaacttggcaaaaagattacatctttttaaacaaaaaaataagactgacgaaatagtcagtcttatagttccaaagaagtcttattatttcttctttgagtttttatcttctttttgtaatttttgagccatgttaataatgtactcacgtaaatcatctttaatttgagggtgagataaaccatattcaattgatgtttcaaggtaaccttccttgttaccaacatcgtgacgttcaccattaaatacatgagcgaatactcgttgagtcttgttcatagtatcaattgcgtcagttaattgaatttcgccaccacgaccaggtttttgatgtgctaaaatatcaaaaatttcaggagttaacaagtaacgaccaataattgcgtagtcactaggtgccttatcaacgtctggcttttcaacaaaggccttaacgttaattaaaccaggttcaatttcgctatctggatcaataacaccatacttagaaacttcttcatgtggtacaggcataacagcaatagttgatgcatgagtcttgtcataacgatcaatcaattgcttagttagtggaaccttgtcctccatcaagtcgtcaccaagcataacagcaaatggttcatccccaacgaagctacgagctcttaaaatcgcatcccctaaaccagctgggtgtggttgacgagtgtagtaaaggttaacacctaaattagtaattgattgggttaagtgtaaaagttcagttttacccttttcttccaaatcttgttctagttctgggttagcatcaaagtgatcttcgatagaacgcttgtttttaccagtaacgatcaagatatcttcaattccagattttttagcttcttctacaataaattgaattgttggtttatcaacaatcggtaccatttccttaggcatagccttagtggcaggtaaaaatctagtacctaatccagctgctggaataactgcttttcttactttcattttattctcctcacaaaataagctttccttagtgtattttaccaaacttctagaaacttatttagacaatttactatttttttctaaaaattctcaaaatcgggctacgactgtattcaatttttctaccttttaattcatcccctgtggcattaagacaaatgccaagcaaaagtaaaaatgaacctacatttagccataacataaagattataaaagaacctacaattccatagttttgccagcgcgttccaaattgcctcaaatataaaccaaagaaataggataaggcgctccagctcactacagtaaaccatactccaggccatacgatgcgcttttgtacagtgatgttgggaatgacatagttaatatacaaatttataataaccataaccaaaattataatcggccaacgataattttccaacttatatacccaccacaaggatagattaaaaattggagccaaaaattccataatctgtctaccaaaggtaacaacaaaaattattattgaaaagccaactaccaaaatcacagaaagaacaaaagtaaacgttctagcaagtaaatagttccaccatgacttacctttttcttttttatcaacgccataaattttatttgctgctaagcgaattgaattaaccaaacaacttaaagaccaaatagcaatcacaataccaagagaaataaaaccactggagtgttttttcaataaagcattgataattggcataattagacttgaaacttgagatggaaaaatcaattcaagataacgagcaattggctcagtgtcgatattaagcaaaggtaaaacatttccaataataattatgattggaaaaatacttaatagcacataataagcaataataattgaagtctgatttatctcgccttggctaatatatttagataataactgaaaaaactctgttatacggtttttagtctgattgagaaaagaattcatggtcttactatctattaatcttcatctaaaaagtgaggaagatatttttcatagccatcatatggcttttgcaaagttaagatctttggtccatctggagtaattgcaaaagtatgttcaaattgagctgccttcgaaccatctggagttgcatagtaaacccaatcatcattaggatctgatacagttttttgttcgattctccagtctccaccagcttcaaccattggttcaactgtaatagtcattccttcgcgtaaacgcagaccatgacctgccttaccccagtgaggaacttctggatcttcgtggattgatggttgaataccatggcctacaagttcacgtacatcaccatagccattttcatcttcaacataattttgaataacgctaccaatatcaccaatacgatttccaacaaccgcttgatcaattcccatgtacattgctttcttagtaacgtccattaattttttgtcttcggcagaaatttcaccaacaccataagtagtacatgaatcagtttcatagccatcaacgttgcaagtaacgtcaacgctgactaagtcaccctcttttaggatcttatcttttctaggaatcgcatgagcaatttcatcgtttacactaatacaagttccatacttatatccttcaaaaccttgttctgaaagacgcccaccatgttttttcataaaatcttgagcaaattcttcaatttcccaagttgaaattccaggtttaataacatcacgtaaaccttcaaacatagctgctaaaacgcgaccagatttttgcatcccttgcaactcgcgctttgatttaattgttatcattaaaaagtctccttttttaatttatatactcttagcataccttaaataggtatgattttgtagttattaagaaagtctcaaccattcattataaagcttttcttaaataatttctcttaagatttacaaacctctatacttctttagtataataagagaaaacgttatagaaagaagttttttgcatgaaagcacaaattgtctttgccagcatgactggtaatgatgaagatatggcagaaattttagaagaaaacttacaagatgcaggttttgacgtagaaaatattgacgtcagttttgcagatgctagctcttatcttgatgctgacctttgcgtgatggttacttatacatatggcgaaggcgtgatgactgatgaattaaaagacttttatgaccaactgatcacacttgacctatccggtaaaaaatttgctgtaatgggttcaggagacaagacctataaagatcactattgtgaaaatgtagatgattttgaaaaagcatttattaaatgtggcgctattgaagcagcaaagccagttaagatagaaaatgctgtcgatgatgatgatatcgccttaattgaccaagctactgaagaaatagttgaggcatttaatggctaaaaatcaccctaaaaggaagggacaaaagattactcaagagcagttgagagaactcgggagtaaattggttgcgagacaccgaaatttttatgtttatgttatcttcggttttctagcagccgttattaatattgcctgctttcttttattgcataatatttggaaaatgcctgtgatttatgccaacacaatcgcatttattatttctaatttagcctctttttcttttaataaacatggtgtattcattcaaaatgtcgataaaaagcatggagtagtttaccaaatttgtttattctttatttaccgagtcattagtttagtcccggataacttaattatgctagttggtatttcttggcttcattggaatgcattttttgtaaaaataatcgatcaaattttagtaggtattttcaactatttaactaccaaatcaatttttcttaatactagtggtaaattcgctaaaaaatttaaagactactttaataaaaagtgatctaaaaaagctccataaaaatggagctttttttagttaaaatcaactggtttttgattatgttccttgtcaaaatagtaagcaattgcatccataatccgatcagctgcttttccatccccatatggatttttcgcatttaccatttcagtataagctttttcatcttcaagtaaccgtatcatttcagcacgaaccttctctacttcggttcctacaagctttaaagttccagctgcaactccttcgggacgctcagttgtatcacgtaaaactaatactggcttacctagagaaggagcttcttcttgaactccacccgaatcagtcataataaagtagctttttttagctaaattatgaaaatcaactacatctaggggtttaatcaagtgaattcgcggatcgtcacttaatacctctttagctaccttttgtacacgtggagacagatgaaccggatagataatttcaacgtctttatgactatcaactacctgtttcataactttaaagacgcgtcgcatcggttctccttgattctctctgcggtgcatggtaactaaaataatcttactatctgggttaatttcatccagaacatcgtgatgataatcttctttaaccgtctgttccaaagcatcaatggcagtattcccagtcacataaatattatcagcgggatggttttctttaattaagttttgtttgcttaatttagttggtgcaaaatataaatcagttaaatcatcagtcatttgccgattcatctcttctggaaacggagaatacttattccaggttctaaggccagcctccacatggcctaactttgtttgttcataaaaagttgctaaggcagccgcaaagctagttgttgtatccccatgaaccaaaacaatgtctggttgctctttttttattactttagccatatcaagcattacttttgaagtaatatcttctaatgtttgatttttatgcatgatattaaaatcatagtcaggtttaattttaaaaatatctaaaacctgatccaacatttcacgatgttgagcacttacgactgttatctcttcaaaacgatcatctttttttagcttcaacactaagggtgccattttaatagcttctggtctagtcccaaaaactgtcattacttttactttattcataatttatccttaccttatattttgtatcttctactataccccaattaaattttctttggtactatttgtcaaactactttatacttatatactataaggaaagtgagcaatttatgtttagttttttatctttagctgcaattttaattaccattatatatagtcttttgcttagttttcctctttgggaactcttacccacaaaaaactaagcatgttttaattggaattattgcaatattactaattatttttctctggattgttttagagatttttattaacccattaaaatatgtttaagatgaataaaaaaggctgtataatttttcctgttgatgaatatctatgatattctatcgacaggatttttttacgtaaaaaaagaggccatagtcctctcttacttaaaatccttcttcgaccaattcaattaagtgtatggagatttaaactatgtcctctttaaatgattatattaaatttactcttgatattgaagataaaaacattattttttctgattattcaaatgaaaatattaacggtaagatttacaaaatatatttagctgagctgatccagcctacttgtccttattgtcgttctactaatcttaagcataacggtcattacgtctctaacgttcgtttcattactgctgatgctagtaagcccgttactatcagattaagaaaacaacgtgttctctgcaatgactgtttaaaaagatctatggctcaatctaatctggttaataaaggctgctatatctctaacacttctaagcgaaaaatactttctgctcttactgaagatcgttcaatgaccagcattgctagagaacataatgtatctgtcaacacggttcaaagagtattagaagtctgctcttctaagttctatgatgcctttgatcatctccctgaacacttagcttttgatgaatttaagggcgtaggcaaaaagcttcactttatttgtctagatggtgatactcacaaagttgttcaaattcttagaactcgtttcaaacctgatattctacgctatttttacaagttcactcctaaagctcgtgcaatggttaaaacagtaactatggatcttaattgttattatcctttagttgctagagaattatttccaaatgctcagatagttattgaccgttttcatatggttcaaatgcttactagatcgtttaatattttcagagttcaaatcatgaagcaatttaataaaagaagccgtgaatataagcttttaaagtccccttggaagctttatctcatgaaatatgacaaacttaataagactactccttattacgactggcattttaaggactgtctaacacaggaacatgttgtcttagatggtttagattgtgaccaaaccttagaaaatacttattgggttatgcaggactttatgactgctattcaggataacgatgaaaagaaagttatccatctacttcattcaaaacaaaatgttggtaaacaaatgcatcaaactctattaacttttaaacgtaattattctggtgtcctaaacggtattacctcaacttattctaatggttgtcttgaaggagttaaccgtaagattaaacaaattgaacgtactgcttatggttatagaaatttcaaacatttattaattagaattagactcgaagaaaatattataaaagaaaaggaatcaaacagctatttcttagctgcttaattccttcttaaaattatccatcaacaggatttgcaaaagagcccttttttctatcttataatcttgaagtcaattcaacatcaggatacttatctttaaaccatctctcagcaaatgcattttcaaataagaacaatggctcaccatcccgatctttaaccaataagttacgggatgatgacattttaggatctaattgatccgggttaatccaacgagccacacggtttcctaatgtatggagctcaacttctgaattgtattcatttttcattctgaaagagaatacttcaaattgtaattgaccaactgcccccaaaatataatcatcagttgaatagccacgataaagttgaatcgcaccttcctgaactaattgattcatccctttatggaatgatttttgcttcataacatttttagcagttactcgcataaaaatttcaggcgtaaattgtggtaactctggatagacaattttcttctttccagcataaattgagtcaccaatctgaaaattacccgtatcatacaaaccaactatatctccagctactgcatcagaaacttgtacacgttcactagacataaactcagttgcattattcaatcgaacaggcttaccagttcgagctaaagttacatcaattccctttttgaattcgccgcttccaattcttacaaaagcaattcgatcacggtggttaggattcatgtttgcttgaattttaaaaacaaaaccagagaattctggatcatctgcagctaacttttcatcttcattaaccacatgttcttgaggagcaggtgctaaattaacaaaactatccaagaaagtttctaccccaaagttagttaaagccgatccaaagaagactggtgtttgatctcctcttaaaatcttatctttatcaaaagtatttccagcttctttcaacaagtcaatatcatctaaagtcgattggtatagactatcctgtgctaaagcttcatcttcagataatttgccattttcatctaatggtaaatagcgatcatcttcatcttttcgatagagttcaacccgattgtttgcaatgtcgtataagccttttaattgctttcccataccaattggccagttcattgctacaccttcaatgcctagcaaatcttctaattcagcaattaagtctagtggttcacgtccatcccgatctaatttgttcatgaaagtaaagatcggaatacctctcttctttacaactttaaacagctttttagtttgaggttcaatacctttagcagaatcaataaccattactgcagcatcaacagccattaaggtccgataggtatcttcagagaaatcttggtgtccaggagtatctagaatattaattctctttccttggtattcaaattgcattactgaactagtaactgaaataccacgctttttttcaattgccatccagtcactagttgcatagtgaccacttttacgtgctttaactgtacctgcgcttcgaattactccaccaaaaaggagcatttgttcagtaattgtagtcttacccgcatccgggtgagaaataatcgcaaatgtgcgtctttttttcacttcatccgttaactttgtcattaatctttagcttcttccttttcttgtttttctggaattgtgagcagcagtgttaataaacgagaacctttcattcgtctcgtggttaaaaccatcccattatcaagtttaacgctcaacttctctcccttagcgggaattagacctaatttagtaattacatatccagcaacagtatccacattttccattgccaaatcagttccaaattcttcattgaagtcagctaaaggcatttttccataaataacatactctcttggcccaatttttgaaaataatacctcagccttatcaacttcatcgtcaatatcgccgacaatttcttcaattaaatcttcaattgttgcgagtccaacaacgccgccgtactcatcagtcaaaatagcaagctgtctttgggtctcctgcatctcgactaacaattctcctaattcaatagtttcaggtgcaaataaaggcttaaacataacctgatcgtagtctagcttatcaaaaccaactttatgagcttttcgtaagacagttctaatatgaatgacgcctacaatcttatctttatctccatcataaacaggcactcttgaataaggctcttttaagatcttatctaagttttcttgaaaactatcattaatatcgaccatgaaagcatcagttcgaggcaccattacttctcgtgccatcttttcctcaaattcaagaataccttccatcattgaatattcacgatcgctgatttctttttgctcatgtaatttatttaaaattttatttagcttacgttggccatcgatatcttcatcgccacgaaatttagctcttaatttgctaaatatatcccccgcaccgggatcactactcatctttaaattctctctttctattgatgtgttaaggcccattttaatcacaattatcggtaattatatcacatgcaaatatatgataaaataaggaacaagaaatggggtcctatagatgaaaaaacaaaacatctacttagtatttacttttttactattaattccgtatatttgcagtttaaccctagttggtatctgttataatgccttagttagacattctagtgacatttttagaagttttatcggtgccctagttggtacaattattatgtttgcaattaaggccactattcaacgtccacttgatttagtctctgatgaagtaccaaataacttgtttaaacagattttacgtttttatagtattcgtagacgtaaatttctacttatttgtaattgtttagttgactttgccctctgctggcttgccatggacttagtaagaaaattcttctcactatcttttattattggcaattccgttgggatagtcttattgatcatgctaatttcaacatgtattggcgcttatattgaatatgataatctttctattgaccctaaacagaagtaattattttgaactttcttcagaactggtatctagatataaaatctgggccagttcttttgtttctaagtttaatttagctaaaacatatggtttttcactatcgcctaaattttcgtacatagtaatgccatcttttgacaatttatctaaaaaagtaggaataacaaaatttaaaggttggctaaagaaagctaaattactatctggtgtattaatttctgcaatttctgaagcaggtaattcaaatttatttaatcctgcaacaggcatttgtttgtcatcagccaagattccataccaaaacataaagttttctggtccaaataccaccaagcttgctcgttcattttcatacccattgtctttgataaacttttggaatacaggatcattttccatctcttgaatagcagctgtatatgtcttattttcgtcaatttgatttggcataaaaaccttacctataaagttatgtgccgagtatttttctttcttcattttctctccccttaaaaaagcttcgatctaagtcaggacgtaattggttatagcgttcataccaaatttgtacaaactttctagcaaacggtcccttcttttgatcaatccaatctaataattcaaaactagtactacgcaaaatactatcaatctcttcgctataatgccagcgttttttgttcattgcatactcatcggcatctagaagtcttttttctccatctggaaaaactttaatatctagatcatagtcgatatattttaatgcttctcgatctaaaataaatggactagctaaatttgcatagtatgcaacaccatctggcctaagcattgctatcacattaaaccaaagtttacgatgaaaataaacaattgctggttcacgactaatccattttctaccgtcttcttcggtaattaaagtccgatcattaacgccaataataatattttgttctgttttaactaccatagtgtcacgccaatttcggtgtagcgtaccattatgtttataactttgtattgcgatataatcgccttcacgaggcatctccatgatattcgcctcctaactaaatattataccagcaaattaatattcatctatttcttctaaatttactacttcaccacttaaaaaactatcaatctctccactggaaaaaccatgttgaaataagtatcttttaactttctgtcgtctcttaaagtcatcatctcttcgataacgacgccaagctttaattccttgttttttcaaggcctctagttgatcatcttctgtactttctaaatctaactgatcaactacaagttctcctagctcttggttaaaaccatgtgtttgtagtttttttagcgctttttgcttaatttctttatacgacatttttcctacttgatgaccaattgaatgtattaagcgcataccagcttctatccattcttcatcatctacttcataaagagaatcctgaataatatcgttagctacacctttttgttttaatttactactaattgatcttgggccatcttttcctactctaaggttattctggataaataagcgtgcaaaattattatcatcaagataatttaattctattaagttttctatagcactttgactagcttctggactaatcccctgcttatttaaataagttaaaacttcatatacactacgcggctgatagcttaaataagacatagctagctggagcgcatgactatctgcttcagctttttttattttttcaatatcttcaaggcttagttcagttccttttaacagtcttttttcagctaaggttctttcactgacactgaaggcatattcattatcaataaaaatattatagcgtcccttccgcttttgtgtactaatcttagtaataattggcattatcacaccttcttcatttttttatttcttctatattataataaattaaatacttgtatcacttgaaaataacgcttatgcttattgtgacacttttttcatgaatcaatcgaaatgagggccttattttgacaaaatttactaaaaacaaacaagaaaaaaatattatcatcactattaaacgcttgggtattaatggtgaaggtattggatactataaaaagaaaattatttttattcctggtgcgcttccaaatgaggtagttgttgctaagatcgttgatcgccatccacactatctggaaggtgaattagtaagaattaaagaaaaatctcctgacagagttacctttcctaaaggagttgatcctgcagttggtggattagaactcgcacacctttcttatccaaaacaacttgaatttaaacaacacctaattctagaatcgcttagaaaatatcatccaagagactatattaaatataaagttaaaaagacaattcctacaccaaacgcttggaattatcgaaataaagctcaatatcaaattgaatttaataaggggaagagtaaacttggtctctatgctcctaattcccgtcgtcttattgacctgcctgatatgcctactcaaacaaaagagactcaaaaagtagaacgtgaaattaagaaactaatcgataaacttcacatccgaattgccgactttagacgtcataccgatggaattaaaaccattgccgttcgtcaaagcaatgctactggtgaaattcaggtaactttaattacaattggtaaaaaaattaaagatctcaagttacttgctagtcatattatgaaacttccgaatgtagtttctgttttccaaaatgaaactcaatggcaaaatcctcaagtttggggcaataaaactattaaattgttcggaaagtcacatattacagaagaaatactaggtaaaaaatttaagctttcaccacgcgcatttttccagcttaaccctgaacaaactactactctttactcagaagcccttaaatatcttgacttaactcctgatcaaactttgatcgatgcttatgcgggcgttggtactttgggaatcttagctagcgatcaagtaagacaggttattggaattgaatctattcctgaagccgtaatcgatgctcaagaaaactgccgcttaaatcatgtaagaaatgcggaatatattcaaggaaatgtagaaaaattacttccagaactaaaaaatcaaggtgttccaattaatgcattaatcgtcgaccctccacgtacaggattaagcaaaaagttaattaaaactctacttgaagtaaagcctgaaacctttgtttatgtttcttgtaacccagctactcttgcaaaagatttagttcttctaagtgacgcttatgatgttagggtaattcaaccggttgatatgatgccacaaacaccacgttgggaaggcgttaccaaactagttttaagaaaaaataagtaattatattaatttaagcagtcgatgtgactgcttttttgtgcttataaaaaaggttgtagactgcctggtctacaaccttttttcaagtggatgaggtaaatactatctagcgccataacgtcagtatctgggtttgatattatgacttgatcaacatcacttgtttgcatctgtattgaataacgactatttgatcttactaagagaatcttgtctttaaaacactacaatctggagataaaaactatttacaatattattctacctctccacacatcttattataacaactatgtaagcgaatacaagttatttaacttgatattggcggatatcattacgaataccagcaaaataatatctaccagtttcttcatcactgataagttcaacattgttttctggatcttccaaacctgcagaaaagatttcctcatattcggcaacactaagcttgcttcgattatctaataaagctttatctccaaccttatcaagttgtttttcatagccttcaactacatttgcggaataaaattcagccattgcacctgaaccataagaaaatagaccgactaagtctccagcttttaacctaccattttcaagtaaactaagtagactcaagtataacgatccagtgtaaatattacctacatttgcattcaattctttagctgcagtaaagctgtccattaaccgggcatttgtttcttcatccgttccctcaacagctaatctatttgcctttaatcccatcttagtaaaaggtaagtggtagacaatagcggcaaaatcttttgtttcaagattcttttgttctttgtaagcagaaaaagtatgtttgaaaaagtctaagtaaacctgggtagaatactttccatctaccttggctgttttagaatagttagggcgccagaaatcattgatatcctcactataagcactatggccttcatttaattctaaaattcttggattactagaaattaataaactaacacttccagctccttgagtaacttcaccagcagtattaaccccatagcgagcaatatcactgccgataacaatagcagtttgatcaggatgaagtcgtacaaaatcttgggcaatcattaagccagccgttaagccaaaacatgcttccttaacttcaaaagctctcacagtaggatctaaccctaatgccgattttacaaataaagagccagatttagattgatccacactactttcagtaccaaaaatcaaaagtcctacttttgatttatcaatcttatcgatatagcgtagagttgcattaattcccattgaaactgcatcttgagttggatctgcaacgctcatttttttctgtccaatcccaattaaaaatttatttggatcttgattcctagcatgggctaaatccaccatatcaacatacttatttggagtaaaatatccaatttgatcaattccaaccttcatcttatttttgatcctttcttatttcgcttaaaaattcaaaagctgcttcttgagtatattttttactttcctgcaatttttttaaaactattgctttttcaccttcactagcttttaaggttgctactaaatttctcgcctgcaatttcatatgcccagcttgaattcccttagtagaaattgctaaaagagctgaaaagttatttgctaagccagttgtcgcaataacttctgctagttgcttggcagatatattacctaataaactaaagctttgttgaacgtctcgacgagccttaattgagccacctactacaccgattgctaagggaactgttacagtccccactagtctatcttcttcaattttccacttactcaaagatgtataggcaccatttttattagcccaaacagcagttgctgcttcaactccacgataatcattaccagttgcaaccaatacactatcaataccattcataattcctttattattagtcactgcccggtaaatatcagtttgtcctattttactcaataaagctatctttttagcaacttttaatcctcctacactgtcaattgaaagacttactttagcactagtcaattgcgtaggataattagacaaaattgcatacagagtttgttcaatatctggctgcttctctaattcatttcctaaaaattctaaaatagcatttgttttattagctcccatagcttctgctgggtcaaccaaaactctaagaaaaactaaattttctttttgagaagcttcaattttacgaactcctccaccatgcttgactaagctaacgaattttttattagctaagctaattaattgaggaaattcagtagtaaacttagttaaatcaaaattatcagttacctctaaaacaatttgaccatatattccatttcgtctactatcagctactgctccaccattttgattaaaaattttagctgcatggtttgctgctgcaacaaccgatggttcttctacggccattggtacttgataatctttcccgttaactattaacttaggaagcacaccaagaggaagacggacttgaccaattacattttcactaagtttatctagtctttccaaagtttcagactcaatctcacttagtttaattcctttttcagttaaaaagactcttctttcctctggtaaccattgataaaatttctttttagatgattcttctaatttcatatgcgattccttggccaccgccaatacatagagatacaattgctcttcgaccattaattttacgcaaactgtttactgcactcattactaagcgcgtaccggttgcaccaagcggatgtcctaaactaattgctcctccagcgatatttaatttttcttttggaatatttagatcacgggctacagcatatgcttgagctgcaaaggcctcattaatttcaattagatcataatcctcaattgtgctattagtttttgtaagtaattttttaatagcaaaatatggtgcgtatcccatataagcaggatcacagccaatttctgcataggcacccaagtatgctaatggagttaaatttaattcatctaatttttgttgattagataataacaacatacttgcaccatcagttaacggtgaagaattgccagccgtaactcgtccattttccttaaatacaggttttaattgacctagggcttctaaactagaatctggtcgaatggtttcatcatgatcaagaacatgaccatcgagttcaattggtgcatactcttccttaaaccagtcattctcctgagctgcataagccttggcatgagaatcacgtgcaaattcatccatatcttgacgcgtaatatggtatttatcagctacattctcagctgtaattcccatcggctttctcgaataagcatccccaattccatctatcattaagctatcttgatatgctggattttcatcatgctttttacttttatcaagtaaaagtggtgcatttgtcatactttctgccccacctacaattgcaatttgagaatctcctaggagcatttgaccttgagcaaaccgtaatgcctttaaacttgaaccacaaacgtcgtctacgctagtacccactacagattcaggtaaacctgattttaaagctatttgtcgagcgacattttgacctagcccagcacttaatacatttcccaccaaaatgctatctattttatcttgtggaacaatattctttttcaataatcccttaagtgctaacactcctaggtcaacagcacttttatccttataaaatccacgatacttaccaaaaggaattcgattcattcctactatataaacatcctgtaacactcttccacctcttaataaaaattattctattaacatgatagctcacgccatgcatcaaatgtataaagtataatttttttaatcaattctaaaaaaagattgctaaacaatcttagcaatcttttacatatacttactcaaaaaattatttactttctcctgatattgaatcgggtgagtcgcaaatgatttagcatgtttagctccgggaacaacccaaagttctttcggaccatttgctgccttatagttttgatagaccatctgtgttggtacaaaagtatctttagcaccatgaataaacaatattggtcttttatttttagcaacttgttttacgctactagcatcttttaaaaagtaacctgctctaattctagttattccacttaaaacttcaactaaaggaaaacggggaaaagccggaaaatgatataagtcttctgcttcgtgttctatctcatccttaacattagtgtagccacaatcctcaatataagcttttacttgtttaggcatttttagtccacttgacatcattgttgtagcaccacccatacttacaccaaagatagcaatctgactcttatttccattccttttaataactttctcagcccattttttaacatctactttttcacgccaaccatacccaatatagtttccttcactttgtccatgaccacgtgcatccggtaatagaacattgtagcctagtttatgaaacatagcagcataagctcccattgtatctttattattcataaaaccgtgcaggacaataactgtctttttagaattatttactggaatataatttgcatctaaccttaaattatcatctgctgatttcataatccacttttgtttatgcacattttgataccactttttttccttgtatagtgggtcagttttaactagcttagtatcattgttaataaaagatttatgtcctggaacaacagcaacctgatagaaatataggcctacagctaaaaaaataccacaaactgctaaaatagatataatagctatttttatttttttactcttcagcttcattagaagacctcggttctaaaatataatctatactatctctaaaaaatatagaaatcaagagaggataaagatctatgtatttagatgatttcttaattttaatttctgatctccatcctaattttcaatttttttatcaaaataagaaaaatggcgtaattgatccaatcagtaaagtccaaattgacggagatcgatgccttttatatacaggagaaaatgctaaaacaattgctcaaattaaccatttactgggcaaattaaagtctaaccatcttcctatctatgtatgtacgaagaatacaaacgaaaaaaacaaaatttttggtatcaaaataaatttagtaaagggacaggtttatattttataagatagcaaaaaaagatgcagaaacaatctacatctttttttgctcatcctagtttttatctaaatattcatttaaaactctcaaaactccattgtcattattgctaggagccaaatactttgcatgttcttttgcaatagccataccattttccattgcatagctatattttgcaaaatctagcattggaatatcattaccactatcaccaaaagcaattaaatcttcaccagttaatccaaaataagccagtaactttttcaatccagttgccttattaattccatgtttaacagcatcaatagctactggatttgaagcaaaagtagtcacaatattcccatattgctcattaaattttttctcaatctctccagctattttactatcatgatgaaaagtcaattcaataaaggtatcatcaggtaactcttcccaatcactgatctctacactttctttagcgaagtactgcaaaaattccttatcttttgctggtgcttcagttccaatatatgctgtctccctgccataggccattgtcgccatacttccataggtatgatggacaaaattaactaaatcaatggtctgctttttagttaatccttcaacagccacttcttttccttcaacaattagtcgagaaccattggcagtcacgaaatctacgcgatcaataaattcagaaaagtcattttttaaacgagcaaatggacgaccactagctacaataaattgaatattatgtttttctaatttatttaaaacttgagcaaacaaatcatggtcatagcttctttggtcgtttaaaaatgttccatccatatcaaccgcaacagctttaaaaggaatagtcatattcttctccttactaacggtgatttaaggcaccatttaatttcttacgatatataaagtaaataattaaaataattggcacaataaccaataaaactgggtaaaagtaatctggagctagattttgagcagtcacaccaccgatcattggaccagctgccattcctatatcaaggcccaaataaaaagtcgaactagctaacccttgttcttcaattggagctaacatcaaagcggtagactgattcacagagtaaataaccccatatccaatcgaaagcataattgcagctaatcccattaaccagttattgaccataaaagtagcaataattaaaaataaaatcatcgcaactaaacttagccagaaccaaaagccaaagcgaattaaatcaaaatacttttttaaaccaattctaattaataataaggcgatcgcataaattacaaaaaaataacctacagcaattgaaaaatgctgtctttcaacatacactacaatgtcggcttgtgtaataaaatatggaattgcaaaaaaagtagttaataacgctacgggaatagcatctttttgaatgatttttatttttctttttttattattagtaattttaggcttagcatggtttccaacaaattgaatagaaacaatcattaatagtgctgcaagtacagcgagccaaagagctgacttatagccaattattttatacaagttaatagctaaagctggtgcaagagccatggctaaagcattcatcaagccataaaatcccattgcttctccaacatgactccgaggaaccagaaatgctaaccaggtagtcatacaaactgttgcgagcacaaaaccagtaccattaattaacctaaaaattaagagccaatttcctgatggagagaaacaataacctgccaccccaattaaaattaatactcctccaataaaggacaaactatactttgaaaaacggtcagttaaattaccagcgaccggtcttaagaacattgaaactacactcataatccctgttatcacaccggcaaataccgcactagcacctaaactgattgcatagccattaatcaagggtgttacaaacattactgagaacataaaaaagaaagacgcggccataaccagaataacgtctttagtataaattgattgcttctgtttcaattttttactcctatctagcattatcacttttaactttatcatactttgagtttaagcaaaaaagccagttgaataaatcaactggcttattagtttatattacttaattaataccccatgtaacggtctctttcccaatcagaaactgattgagtgtacttagaccattcaaggttcttagaatcaataaagctttgagtcaagtgttcacctaaagcttcttgaattagtgggtcagccttaaaagcttttacagcattatgcaaagtagatggaagtggtttaatgcctcgcttagctctttcttcttcagacatttcaaaaacattagaagtaataggagccattggcttcttagcctctttaataccatttagtccagcagttaaacaagctgcaaggagaagatatggattagcagttggatcagctgaacgcatttctagacgagtgttaatttcttcagcatctggaatacgaacaagtggtgaacggttcttagaagcccaggaaatataaacaggagcctcaaaaccaggaattagacgtttatatgagttaacagttggattaccaattgctgtaattgcacgggcatgttccaaaattccatttaagaaatagagagctgtatctgataagtggaattcaccatctttatcatagaatacgtttttaccatctttaaataaagacatattagtgtgcattccgtttccagcttgaccttctacaggcttagccataaatgtagcatacaaaccatgctttcttgctacttcacgaacaaccatcttaaatgtttgaacacggtcagcagtagttaaagcatcatcaaatctaaagtcaatttcttgttgaccatcacctacttcgtggtgagcagcttcaacttcaaaaccaatactttctaaagtttcaacaatatcacgccgacatcttgcaccagcatcgtcagaagtcatatcaaagtatgaagcatgatcaggaacttcagtagtccagttaccatcctcacctaacttaaataaatgaaattctgcttcaaaaccaatatcaaaatcagtaaagcccttttctttcatttctttaagaacacgcttcaagttgtttcttggatcaccttcaaaaggttcaccatttgtcttgtgaactgaacatactaaacgaccgatctttccacccttttcatctccccaaggcaaaactgcccaagtagaaaagtctgggtataaaaccatgtcactttcctctagacgaacaaagccatcaattgaagaaccgtcaaaacgaatatcattagttaaaactttatctaattggctagttggaacttcgacggctttagatgttccgttaatatcggtaaaggctaatcttagaaaacgaacatcgttatctttaacactttttttaatatcttctgcagtaatagttttactcattgtacacacctattctaaagaactatagtccaatattataattggtatagtccttaaaaatctattcactacttgtgcttatgcacattgaatacaatagcagaccaaattggtctcgtcaataaatattaatatttctttagctatattttaaactaattgttataaagaatactaataatacactattataaccataattttttatttgtttaaaaattcatttatttttctaagagccttttcagatactttttcatcttgcaaaggatcaagccaaacaacaggtaattggtgtttgaaatatgtcaattgacgtttagcatactttcgagaagcttgtttcagcttgttcacacattcatctaaagtcttttctccagaaaaatatggaaagaattctttatatccaatagcttgaattacttgatgttcacgagacctattttcataaacgaactttgcttcttgtagtaacccatgctccatcattttatctacgcgcatatttattctctgatagacttcttctcgatcactatttaatccaagaattaaagcatcatatcgcggattaatcttttgttgttgttcactaaacaatttaccggttctactaattactgttaatgctctaagactacgacgactattttgcggcgctattttttctgctgcagctggatctttcgcttgaagaagatcccacaacttattttctccattttcttttaaatattcttcccattgtggatcaacgcttgtttgatactcccctggttcaccaagttgaagctggttgaccaaggcattaatataaaatccggttccccccacaactaatggaatggctccatcagcaacaattttatctactgctttggtaccttcagcaacaaaatctttaacagaatattcttcaaaaattgaacgttgattaattaaatagtgttttactcgttttagttcttcatctgttggcttagcggtaccgatacttacctcttgatagatttgcattgaatcaccagaaataatttctgcattaatttttggagctaaatctaacgctaggtctgtttttccgatcccggttgggccaattagtacaataattttttgcatataaaatcctcttattttcttggtatcaattctaacaaaaatcttctttttcttcagagttaatatagcaaaaggctttattgaattaagaattattgctaaaatttgaggtgataaataatttctagggaggcatttatatggcaaagaaatttggtgccggtgttgtaactggtgttttagcaactgttggtgcacttgcagcaggacttgctacttacaagaaaaaggtagtagaacctgagcaaaaagaagctgatagaatcgaacaaaatagaattaaagccaacagaaagagctactcagctcaccaaggctaaataaaaaaagagagattaatccctgtaaaaaggtgttgatctctcttttaatatttagaggccttagtttgaccatcccatttttcaaaaccgtcttttagccagtataccttttcatagcccttcttttgtaaaaagcgtgctgctcttaccgtcaaggcatttgaatcagaataaagataaactggtaaatctggacgaatttcttgatattgatatttaaacattgtataaggaatattacgtgctcctaaaatatgttcttttttaaaaggtcctttttcacgcacatcaataatttgtgcttttcgctttcccttttcaaattcttcattagttaatgcaccaccgactcttttggattggatccatgtccaaagccaactcaaagcaaaggccaaaataatgatgattaagataatgttgataatcccaaaaatattcattaattacttacccctatataagaatttctatagtactatgataatccattactatcttttgcgctagtttccttttcttcttcaatttcatgttcgtgacttaaaatcaattttgcattcatgtattctttcttagaaactacacctgcatgatataaattatccagttcaattcccattagttctatgtcccacttacgtttaccaacataaacgataatattaaacttttttaatagcttttgaacatcatgtaaatttttcattattaattattaatcactattccctgatgtaaacagaagacaacataaataattattactactgctgcgataactcttaacttgtgatgatattgtctcaaatgggcactaccaaaaattattcctaaaagaaaaccagatattaatccaccgagatgacctaagatatcaatatgacttgcaaataaatcaagcgctaagttaatgatagctaatgctaaagcctgccttcccaaataattaattgccggaattgctcgattggctaaataaagagcaattactacaccaaaaagtccaaataaagctgtagaagcaccggcactaactaccgaatcgctcccatatgcataacttaacagatttccaccaatccctgacaataaataaactgttaagaatcgccagtgacctaaaagtggttccataaattgacccatgtaataaatcattactgcattagatgcgatatgtaaccagccgatatgcaaaaattgcgctgtaaacaaacgccaccattgatgttcaacagtaacaagttgattattcattgccccaagtcgaactagggtattaatattagtcgagccacccattattgtttcgattatgaaaacaacaaagagtacaattaaaatcgcatttgtaacaaaagtgctagaaaatcgattagtattcaacttttgcattatccatcatccccttcatttacttaaaataagattttctattggaatatcatgatcctcaattttccattttgtttgatcaaaagcctgaacggaattaactagactaagagtttgagtaggatatttctttaaaaagcgatcataatatccaccaccaaaaccaagccgactatttttatctaagccataagctaatcctggtacaattattaaatctaaatcattttttacctcagcttttggatcgtgattttctaaaaccccaaacttagttttttctaaagaagtgtttttattataaagtgtaaattccatctttctatttggtaaacaacgtggaatatatactttcttttttattttccataaagtagcaataattggggctgtatcgacttctagagccattgaaatagaaataccaacattctctacttgatgtaataatcggcttttaagtagcttttcttttaagatttcatcttctaattgtttttgctgagtttttccaaattcagtcagttttcttatttgtaaatttcgtaaatcttttttattaattaaattcattaaataaaatattattagatacaaaaaaacaacaggaattgcctgttgctttgattacttagtttcgcggtgaagtgttacctttctttcaactgggcaatacttctttaaagctaaacgttccggatgcttacgcttattcttttcagataagtaacttctatcgccacattcggtgcattcaaggataatatgttctgccatgttttccaccacctacttatttagttaactgttaaactataccatgttttccgtacttttaccagtacttttctatttattaagtttgaagtagtcttcaaccattgcctttgccacttgcaaagtatatgaaccttctttatctgggtccagtcctgggaagaccacagctacagcgatttcaggatcctttgatggggcataaccaacaaaagtagcgttaataacttctggcgcattcggattacctgggttatcttcatcataataaaaagtctgagcagtaccagtcttaccagaaatcgaaggcttaacattctttaatgaatgggctgttccccatgaattagtaccatgaacaacacgatacatcccttgatgaataacatcaagttgatcctgcgtccaaggaatacgcatctgaacctgcggcttagtgttatgaagaattgatactttattaccttgcgaattagtctcaccaactgattgaactaaatatggacgcatacgataaccaccattagcaatagttgaaatatattgtactaattgaattggtgtataagcatcatagtttccgtaagacaagtcaagaacagaacctgtaagcaattgaccagctgagttatatgagcgaccttgaatacctgaaacttctccaggaaggtctacaccagttttttgacccaaaccaaacattgcaaaattacgtctcaatttagtaaatgcatctgaaggcattgagataaaactatgtggagtatatttagcatttacccatcttaaagctaattgcatcatgtaaatgttacttgatacttcaagagctgttggggcatcaagactaccaaatgtaccaactgggtaaacagatttcttaattggagaacctggcaagtaaattggcgtatcgggcattacgttgttagttggtgtaataacaccattcattaatccacccgcaacagttgcccctttgactgcagaccccataacaaaggatttattaattacacctaacgcatcatcagtatctttattagtctttgcattatgatcaatacctgcaatcgctaaaagtgctccagtctttggattcatcgctactgcataggcaccattagaatactgcgtagcacctgcagctttagcagccgcatattgcttcttcagtgcatcttctacttgttgttgatatttagcattcattgtcaaaatcaaactggcaccactttgtcctttatagacagtcttagtttgttcaacaccatctccggacttagtaactacctgtgacttagacttagttcctttcagaagcggctcatacttttcttctaagtaacttgtacctacacggtcatttcgtgagtaaccttgtgttaagtagtactgcaagttatcacttggtaaaccagctttttctgaagaaacggaaccaatgatacttttaatggattttccatttggatagcttctggaccagtcagttccaatacctacacctggcaattcagataggtgctctccaactaatgccatttctctatcagttagacctttatttttaatatagatagtagataaagtgtatgctccagaaatcttattaaaaattaaagcagccgttttttgacgtttagtaaaatggatatcttgcttttcaacacgttttaagacattgttatagatttgacttgaacttaaagcatccccattactgtcataacgttcagatcgaggcagcttagctgtttccttttctgatattttactgttagctaaataataatcataaagctgtctttgggtaggttcttcatcatcaagtgttatatattgacttaagcgattagaaattttatatatttgactagacgtaatgctagaatttttggtataagtaattgcgttattagctttattacctaccaaaactttaccgctgctatcatacatcacaccacgtggtacattatttgatacaatcttttggtcggtttgctgtacttctgcttgaaaacgtccaccgtagaaaagctgtaagtaggccaattgaccaattaagaataaaaataaaactaaaatgacgcccaaaataattttcattcttaggggcgtcgaagtggaatttctattcgaacctttactctgttttaaataattcaaaattctaacctcactaaactagaattgattttagcaaaaaatgcatctaaattctatttttctcccagtgaaaatcgcaataattatatattcttaagaagtagggtatttatcaatgattatcaacaaaattaaaacatattttaaaaataaatatctatattggctttcttttttactgcctacttgtatctttgcaagctattttctatatcgaggccaggaaattttaaccgttgatctaggtcaacaatatattgactttctttctttttataaaaataatctactctctaatcctttaaactttatttttacattcagtaatggtctagggagttcgtttattggaactagtgcctattatttaaatagtccctttaattttctactattacttttttcaaattcatctttaccaatagctattcttttaattattagtctaaaagtcggcgctattggtttaagtagcttcttttattttcagaaatttttcaagggtgataataaaattttcgctttagccgctagtcttgcttttgcactgagcggttttgttgttagctataatttaaatctcatgtggctcgacagtctaattttattacctcttttactagacgcaattgataaattatttgaacaaaagaagcactatttttatcttaccacgatcactttcttactatggttaactaatttttatactggtttcatggtgctattttttggcttactttattttattactgctctaattaatcattctttctcaagcaaaattattttccactatttcactaagagtctcttaggcactaccctaggcgcctttgtattattaccagccttttttgaaatattaaatggaaaaattaactccgacactaccctttcgctaggttttcagtttgcaccatatcaagctcttgataaattagtaattggcgcatttaattttactgagatggaaaaaggactacctaacatttttctaactagtatttttactctattgtgcctcctttactttatcaatcaacatttttccctaaaagaaaaatttacatcagctattttactattatttctattcctatcttttagctttaacccactagttctgttatggcatttaggccaatatcctgtttggtatccagcacgctttagctttatcttttctttctatgcaatctatctgggtgttcaagttctcgcacatacacacaaatttaatcttacgagcaaaatagctagtctgcttttagtaattagcttaagtatctttcttttattaagtatccatcaaaaagaatttttgagccaaactaatattattcttaccatcctttttcttttatgtagtttactcataattttattttttaactataagtggatcccagtaatctttttcggaatagtaggactagaagtaagtattaatctgctagcaagtttagataatatctcttatcaaaaaaattttgattatgctaatttcactagtaatgtttctcaaactacaacctatttacataaatatgactctggcttatatcgcacagaaaagacatttactcgttccgatgatgacccattcagtaataattattatggggttagcaactttaattctatttctgatcgtgcagctattaatttagtagattatcttgggctagaaaacaatgataattcttttaccaataatttcgctacgcccttatccgatagtcttttaggcatcaaatataatattgttcccattaagaataggcgtaatttacctaaaaaagaacaagttgtatttacgagtgctttttatcgaccagatttagttacaaatacagtcgttaaaagttttaaacaattacaaattagaaaaaattcatctgctttaccacttatttttatttcaaatacccatcagaaaattaccttttataataatatgcctgctacaaatcaaaataatctctttagcaacatcctcggtcaaaaacttaatcttttcaatagtttatatctaacaaatccaagtaaactaaaaaacactaagcatagtaagaatatcaatgaatataaaaagattgataaaaataaaactgctaacataacctttaatatttcctcatttgaaaagggagcttattacctcgagcttccctcaaacttaactactaatgtcacttctattattgttaataatcaccaacttaacaatgatgatttaggtatttcaagtaaattactaaatattggatattattcaacaaatactcctattaaaattgttttcaatctaaacactgaaaatatcaatttaaatggtattagagttcttcaatttagagaagatgaatttaacaaaattattcgtaaattcaatcaaaaacagccagtaactcatcaaacaagtcctatttctttaaaaattaattacactgcacaaaaaaatgaaactttaaattctaccattccttattcaaaaaattggctgatttttgacaatggtaaacttctgcaaacccacaaatttgcccaaacatttttaagtgcccctctaaaacaaggtccccatcaacttactttaatctatgtaccagttgctttcttaattggtcttataatttcaattatttcactcacacttttatttattttcaaaccaaaaagggattaacttactagcttttacgtaagttaatcccttttttggataaattatttaaattagttcaatgtcttaacgtcattgatagtaacatcaaaagttccacctggggtgttaatagttactttttcacccttctttttaccaagtaaagcttgagcaattggtgaatcattagaaatttttccattaagcggatcagattcatcagatccaacaatagtataggtttctggatcatcagtacctacttcagtgtaagtaacagttttaccaatagaaacttcattaggatcaacactatctgcatcaacaacttgtgcatacttaagcatttgttcaatttgaacaatacgttgttctacagcactttgttcatcttttgctgcatcatactctgagttttctgataagtcaccgaatgatctagcaaccttaattcgttcaataacttctggacgttttactaattttaagttttttaattccttctgaagtttttctttaccttcagcagtcattggataaactttttctgccatactaaaaattctccttacctatacttatttttctttgcaccaaacagcttatgttttctacctaaaaaagtcaaccatttttactggcctaaactactatttcgtttcaaatgttcgtcatagttttcgttgtagtaaaccttaccagtcttaaggtttgcaacaaagtagagatagttagacttaattgggttcaatacagcactaattgaatctagacttggattgttaaatggtccaggtccatatcctttatgaacatataagttatatggtgattttactttaatatcctttagtgataaagaatgtttatgcttattcaatgcatacattactgaaatatctgactgaagtggcatattagctttaagtctgttaaagaatactccagcaatcatacgcctatctttagttttaacaccttcacgttctactaatgaagctaaagttaaaacttcctgtactgttaagtgcttcttcttaattgaactgtagtatggttgcaaaacttgatcagtcttatcaaccatttgattaactaattcttttaaagaagctccttgataaacatcatattttgctgggaagagatatccttctaaatgatagcgaacacccttactgttcatagaactagttaaaagtttaggatattgcttctccaaactcttcataaagctcttatctttcattagctttaagaaatcttgtcgactatacttggtattcttgctaactgtagtagcaatactatcaattgtttgtgcttcttttattagaacatgaccaacaactggacgaccacctccaccttgcaattggctcacaatctctttgttatgcattgaaggtgataaataaaaattccctgcttgaaaatttgtcgcactatgactctttaaccaaaagttgaaaacggccgcatttctaataatctttttctcttgtaaaatttgagcaatttgactattagttgctcccgcaggaatatgaacactaacaacatcttcatcatgtcgattgactggttgaagtgcgtatcctacgtaacagcctccaatcaagacaactaaaactaaaatcgctcctagtccactaaggatccaacgagtaacctttttagatgcctgttcctctaactcatgatttttctttttgtcttgatttagcaaatgcttttcctccgaaaatcacaaaaatctaagacaattatagcaaagctccccagaaaagaattaacgaactttaatctttagactttctttcagatctgcttcaattttttccattgctgtagctacaacttcatcagttaatgtgtctttttcatttaagaaagttaatgagtaagagattgatttatgacctgattcaatttgacttccggcataaacatcgattactcgaatatcataaagatatttgcccccatttaacttaatttgagcttcaatttgtgcattagttacatcattaggtactaatagagataaatctcgctcaatagctgggaattttggagcagccttagctttcatccctttatgaagcatagaaacaattgtatctaaatcaatttcataaacatatatctcactgccacgtaatgctttgtcaagtgtagtaacagcatgtgctaacattccaattagaccaatatattgatcattaatataaatgccggcagttctagttggatgcattccttgaaccagttcagcacgatactctacatcttcatctttgatgccaattgctctaaataagttagttaattgcccctttacaaaatagaagtcaatcttttggtctaaatgttgccaattggctgctaaagtatgtcctgaataaagagcagctaaatgttcatgttcattaaatgtattattttcatgatcataaactctgccttgttcaaataaagctaattctttttgcttacgggccatattatagcttgcagcatcaaccaatcctgttattaggttttctctcatagttgaacgacttgagtttaatggccattgaacttcaactactggtttaggatctttagtaaatgaaattgctttttctggagaagtcaacgagtaagaaattgcttccatcaatccttgaccttgaacgatatccttaattctacgcatagcagtttcttttgctgagtaaccaccatgagtttcagctaaaagtggttgagtagatttcaagttatcataaccataaattcggccaacttcttctactaaatctgctggaatagaaatatcccatcttctattaggaatggtaactactaactcatcttcagagcctgcaacagtaaaacctaactgatcaaagatcttttccatttcagctctgcttaactcagttcccaataccttattaatataagatacagtggttttaactactgaaggatttctttgagcatcagttgcttttatttcaccttcattaactgtaccatccgcatcattacgcaataacaatgcagccatatccaaggctttttgagtattatcccagttaacacctttttcaaatcgacttgatgcttcagttctgttagcgtgacgcaatgcagattttcttacactagttccatcaaaaacggcagattctaagattacatcagtagtatcgtcttcaacttctgagttcttaccacccatgacaccggccatcataacaggcttttgaccgtcagtaatgatgatatcgtttggatctaattccacttctttatcgttcaataatgtaagcttttcatttttatttgcttttctaacttctagtttaccgtccttaaaagtacgagcatcataagcatgcattggttgaccagttaaaagcattacataattagtaacatcgaccacattattaatcggacgaattcctgcattccaaaggcgtctttgcatccacaatggactttcaccaatttttacattagaaatttttcttaagtaaaacttaggtgctagtttttcatcaacttgtacatctaattcattagtccagtcaggtccatcttccttaagcactactggttcaactttaggtttttcatcaacaattgcaccaacttcataagcggcaccttccattgataaagtatcagcacggtttggagtaatatcaaaatctaaaatatagtcatccatgccaagtgctttgtatacttcttcacctggttttacatctgcatctttagggaaaacaaaaattccatctgcatattttgcaggaactaccttatcttcaaaaccaatttcttgaagtccgcaaatcatgccgtttgatttaattccgcgaattttaccacgcttaattttttcatttccggcaattcttgccccgtgtaaagcaacaataacatcttcaccagctgcaacattaggagcaccacaaacaatctgaattggttcttcttcaccaacatcaacttggcatttgtgtaagtgagttccttcaatatcctcacactctaaaatgtgtccaactactattttttttaatccttctgctgggtgatctacagatgcgatctcaacaccagttctagtaatcttttctcctaaatctttaggatcttcatctaaatcaagaaaatcttttaaccaattatatgaaacaagcattaatcttcctccttacggaattgtgctaagaaacgtacatcattagtatagaaatcacgaatatcagaaatgccgtatttcaaaattgcaaaacgatctaaccctaaaccaaaggcaaaaccaccatagactgttgaatctacaccagcattttctaaaacatttgggtgaaccataccagcaccaagtacttcgatccagccagtatacttacaaattggacaccccttaccatcacaattaaaacaagaaacatccatttcaactgatggttcagtaaatgggaagtaagatggacgaagacgagtcttgcgatcttgaccaaaaacgtgcttggcaatcatttctagagttcccttaaggtctgacatagtaacatttttatcgattactaagccttccatttgctggaattggtgggagtgagttgcatcatcatcatctctacgatataccttacctggaccaaccatctttaatggacctttagaaaaatcatgcttttctaaaactctagcttgatctcctgacgtttgcgttctaagtaagttttcctcatcaatatagaaagttgcttgcatatcacgagcagggtgatcctttggcaagttcatcatttcaaagacatagtgatcagtttcaatttctggaccttgaactacttcataacccattccaataaagtagctttctaaatcatctaaaataatattaataggatgctttgaacctaaatgtccttcacgaccaggcaaagtaacatcaattttttcttcttctaattttttggcaattaaagtttgtaagaagttattttttgcttcatctaactgcttttgaaagagatcacgaacttgatttacttcttgacccaccttaggtctattttctggggcaatatctttcattgagtgaagaatttcagttaattcacccttgcgccccattaactctactctaatcttatcaagcattttctggttttcagcttgcttgatttcattcaatccttcttcttttaacttatttattctatcgaataagtccatctcattttcctttccaacaaaaaaagccccgtcccaaaagggacgaagcttcgcggtaccaccctagtttgaactagcacaaataaagtgcgtgttcacactcttttcgaataacggtgaaataccggaattgattagattctgctcctaagatgaaattcatgcttctaacttaagtttcttccaccagtaaaactctctctaaaaagctatccacactactaatcttaatcatcgcatttaattataatagtatcttaaaactttttacctaactttgcaattacctttaagcccatttatcagcccaattatggacttgctcaaaaacggcttgtaaatcggcacccttttgagtcagagtatagctgataattccactctttttgtctacagtacggttaacaattccgtctttttctagttcttttagtcgttcaactaaaacacgatcagagcatttactaatgcaacgtgctaaatccttaaaacgcattgcattagtatcacacaaagagctaataattaagccgttccattttttaccaataattccaaaagcatcaataaaatgcgaacacagtgaataatcttctggatccggacagtcagtcattttagttttgctttcaatttcttgggacatatgtattcctcctaaaaaatcaaaataattttaaatcatctatattaagattatagtgataacacttactaaaaacaagctgcaagcttatgaaaaatgataaatcataatacccgctgctactgccgcatttaatgattctgcctttccctttatcgggatatagatctttttatccgctgtttcaattacctctttacttgccccatgagcctcgtttccaattacgagcgctaattgaggaactggggcacaattattcaaggacttagcagttttatcaagaatgcttacatagactggaagaccattttccttaaaactactaatagcttctaaaatcggattttggataatttgaatatggaactggctcccctgcatactacgctgaacttttggattatataaatctacactttcttcagataatactacaccatcaaaaccagctgcatcggctgtacgaataattgttccaacatttcctggatcagttaaattatctaaaacaacccattttccatattcaaaactaaatgattttggttgattaattggtagcaccataaagatatcttgactatttttagtactacttaaatgctgagcaattgcatcggtaatctggatgactttattatcttttaatttataagtcgtatctaatttttttaaagcttctgctgttcctaaaacataaagatagttttcatgactctttaaagcttcttcaactaaatgaaaaccttcaattaaataagtttgggtctttttacgatactttttttgttcaagctttctaaggcttttaattgtgggattatttactgagttaatttctatcataaatttctacttccttctaatctaatattttaaattacctcgcccaaaattaacatgttaaaatttaagttagaatacacagaaaagagcgataattatgaagacagttacaatgagagttacaggcttagtacaaggagttggctttagatggacaactcaaatgattgcccaagaattaggaatcaccggtactgttaaaaataatccagatgggtctgtatcaattgtagctcaaggggatgaactccctttagagcattttatcaaaaaaattaaagcatctccttcagttgctgcccatgttgatcatgtagatttaaagataattcccaatacagaaaaatttactcgctttagtgtggtttattgatactttaacaaataactagtaaactttattgcagtaacaataaagtaggaaaggttatagttaatgaaatcaaaaactaaatattttagtctctttgccatgataactgtgctagcacttaccttaacaggatgtgctaacaatggtcatagcatctatcaagcacccactagtgggccatatgcttggatctttagtctatttggcaaaccaattcaaaatatcatgttagcagtcgaacatcaaattggtggctcaaatggagctggctgggcaattattattattacctttgttgttcagctcattgttatgccacttcgactagcttctcagcgtaaaatgactacccaacaagaaaaaacgcaaaagcttcaacctcaaatgagattgatccaagaagcacttaagaagcctgggctaacacaaccacagcaaatgcaaattagccaacttcaaatgcgtgtttataaagaaaataatatgtcaatgatgggcggaatgggctgcttaccattacttattcagcttccaatcatgatgggaatttatcaagctgtagcttactctaaagaattagcagcttcaagtttctttggcatttctcttggacaacgatccattatcttaacaattattgctacgttgctgtatgtagttcagggttatctttcaatggttggaatacctgaagaacaaaagaaagcaatgcaaatgactttaattctaagtccagctatgactttctttattagtatttctgctccaggcgctttagcactttacttcttagtcggtggacttattgctatcttgcaacaattgattactacttttgttattatgccaaaagtaaaaagagatgttgcagctgaattaagcgaacgtccacttaaagtagttgttactcaagaaacaatcgataacattcttaacactacttcttcatcaaactccactcctgaggcaaataaagatcttcatcaagatttacgtgcacgtaatgccggtaaacaaaagcgtccaaatgattctgacaaagattaataaataaaaatagggaatccttaacggattccctattttttatttatctgactcagattttaataatggaaattcaatcatgaacttactgcctgagccaagtgttgaactaacactgatctttccatgataactttcaactagtttctgagcaatagctaagcctagaccatttccacccttttcacgggttctagccttatctacacgataaaaacgattgaaaatcttgtcctgctcatcaggagcaattccttcaccaaaatcttgaactaaaatcttaactttatcttcttcagtagcagcagccactaaaatttcttttcgatcagtagaatatttaatagcattatcaatcaaaatgattaaaatttgctcaagatgattacgataaatcttaactattgtatcaggttttaagtctgcatcatcataagtaatagtaaagtcttgatgaatcattctcatgtcattaacagttcgatttaatacttcattgacatcagtcgttttatcaggatactgcaaatcaacctgctcagccctagttagatctagcatttcttgaatcaaatgtttcattctcttgctttcttgaagagaagcctgaattgattcttccagtacttgaggatcatcttttccccaccgctctaataaatttaagtgtccttcaattacagctacgggagtcctcaattcatgagatacatctcctacaaattgtttttgctgctgcatataggcttgcattctatcaagcatcttattaaaagatatagccagttctcctaattcatcatttctatgaagatcgggtactcgccttttatcagtggggtctttattaatatcgtgagaaatttgagacattttcttaattggttgtacaacgctattaactatcaagtaagacaacccaataaaaactacaatagcaataactgatagactaatcatccagtgtcgaatagatttcaatacttgattttgttgatccatggaattatccacaatcaaatacccagttaaccgatgtgtcctctcagaaaaaatcttctgatataccttcatatggattttcccttgcgtcgttacaacttttaatacatgactttcagttttactaaattgtggcatcccttcatcgggaacattcccattactaaaaacaacatctccagcaggattataaatcgtaatactagtatcacgattcgataaagtagctaatacatcatcattaaaaacattaccgccattattagaagtaattggtgtttgtccttctaaaatacgattcgtattaggagaaagctgaggtacaacatttgaaatttgtaaacttgttggaatttcaacgagtcttctttgaaatgtagttgctacactctctgtcaaatttctttcctgtgagataatttgttgcttaactaaagaataaattgcaattgaaaatataacaaaagagaccgtaattgtcgctgcaactaaacttacccacttaaaagttagtgaggactttagggtctctttcttagatttattttgtttcttcacgtgcttcatcattttcatcagttcttaccatataaccggtaccacgaacagtcttgatgtatgatggacggcccggtacatcaatcttattacgtaaataacgcacatagacttcaacaacattcgtttcaatcttagattcaggtccccaaattttgtttaaaagctgctctcttgtaacaacattattcttattttcaattaatgtcattaacaagttgtattcacgtttagttagatcaactgtactatctccgcggtgaacaattcgattagctgtttcaatagttaaatcattgaagtgaactaccttttgaactcccatcgtatcgcccatagctctcttttcaatttgtactcttcttaaaacagcacgtaaacgagctaataattcttcgattgcaaaaggtttaacaatataatcatcagcaccgtggtctaaacctgagacacggtcaattactgaatctcttgcagtcatcataataattggagttgttttttcttggcgaacacgacgagcaatttctaatccattaagatctggcaacattaaatctaataaaattgcgtcaaaatcttcatttaaagctaaatccaatcctttccgaccgtttccttcaacttgagtttcatatttttcatgtcttaattctagttctacaaaacgggcaagatttttttcatcttcaataatcagaattttactcattattttctccactactatttaatctggttaaaaattttattaataaattaatattaaatttaaagatacattaatgcaagggtttattacttgtttttttcatctttaaataaatccttaagcttagcaaaagcaggattttctttattagattgctgttcttgataagcttcttgagaaacaaccttccagccctctccttcaggaaagtctcctttagcttcttcttcaggagtcaagatcactgatggtaagcttaaaagcaagttatcttctacagccttttgaagatcaattgtatcgtctttaacagttacaattgtatcttcttcatcaagctgttcttgagttggttcaacttcactatagttctcagtaaagttgaatttttgatgcatttttactggttttaagctacgagttgaaggtgccacaacatctgcttcgacagtaaagttaccagtaacaaaaggttcatcatagaagaggtcaccggtaacatgaacattctttgcatcttccagtaattctttacttctatcaaaaaactctttacttaactcaacgttctcatcaacatgagttaatggattacgactatttttaatttgcgaatatgaaaactttaacattattttacctcgattggtttacgaccaaaattttgatcttcacctataatttgttcaaaaagccgatccacttttacttgtaaacctaaagttccacttgcagcatttttcttatcaacttttgaaataatcggcacttgaacatcttttctaattttcttaagataatttcttcctcgactactgtaacctaacagtagggttgaaacatcttgataagaatcctttatttcgttctcagtgacatttaaaagcgtgtaaagacataatcttcttaaacgagcataagtatatcgcttagacttaatttgccgcaaaaatgaagtaaaatcttctgcagtatgaatttcttccttcattttgtattctagtccttcactcatttgataaattgactgcaattcttctaaacttgcactttcaattcgatacttcaaaaagctaaataaaagattccagttcggataaactttttgactttctaaacttactaattctcctttaggaagatatttttttaattcagataagtcattgggatgatgcaaacaataatttctaatagccgtagctgaggaaactattttatcttgtaaaagtggatcatcgtgtccacttcctactcttgttataggatgtaaatgaagtggattctttaattgttcacttgcaactgcataagcaacagctaacatcatgttaggttgatttacttcatgccccacttctctagcaaccatttcattatattgagtagcataagtttgagtgtagtctcgaaagtccatccgattcttgggaatttgatttattttttgacccaaataagagaaatttaaattcgcatcctctactccaaaaaataattctgacactcccaaatcactcaacattttaatactaccattagcaaaaatatcagctggctgcacagcaaaagaaaatggtagttcgaataccaaatcggctccagaagctaaagctgcctttgctctttgccacttatccataatcgccatttgtccacgttgaacataattacctgacattacaacaattattggatcatttttagctgctaagcgggcttgattcattaaaaactcatggccactatgaaaaggattatattcggctacaatgccaattacactcatactcttacctttagtctaagtttaattctagtttcttaccattgctccaaagcttttctaagccataaaagtctcgggcatcttcagtaaatacatttacaactacatctcccatatctaccaagagccagttagaatcacgcgttccttcaatacggtagtcttcttttccatgttcatggatcttatcaataatactgttaacgatggcatgaagttgacggtttgagccagctgttgttacaacgtagtaatccgctaaaatactaattccttgcatatcatatgcttcagtatcttcaccatgtctttcatcgattgcttctacagttaaatctaataatttcttactatccaattttatttttcctttcaaaattctaatcctttactgcccatttattgtaagcagcaaatgtcttaggataaatcttttttctattagttattaaaaaatcaagtgtgtgggctaattcaaagcctaccccatcatctaagttagcaaaagctacttttcttgcttcttctacgccaggaaagtcacgacctggttcaataaaatctgctacaaagacaattttatctagcgtggtcatttctacatcagcagtagtatgacgcttaatagcagttaaaatttctggatcagttatctttaattccttttcaataaaatatgatcccacaattccatgccaaatagctcgattataattaagtaaatctggatcaaaatgctgttccttaatcacttcaataaatcgggcaggagagacttgttttgcataatcatggataaatcctgctaaagctgccttatcaggatcataattattaagttcagctaacttacgactagtttcacttacaccaatacaatgcttaaatctcttttcatccatgttgcttttttctttggcaacaatttcatcagaagttaacggggaatatgttttaacaaaattaatttcagtcactatataagcctcttgatttaatatataagcgtacactttccggtactaaataccgaatagaattaccggtagctatattttgacgaattaaggaagatgaaatatctaaattaggtgcatcaacccaaatcattggaaacttgggattttgcggataatttggtctcctaacgccaaccaaagtagataaaagtgctatagtctctggttcgcgccaattttcaaagtcgtttacttcgtcactacccataattaagtaatattgattacgtggggctctcttctttaagtaacgtaaagtatcaaccatgtatgatgttccaccacgcattatttcaaaaagcttaacatgaaagtgtggattatcatgtgtaaccaattcaagcattgcacaccgatctttagtgcttatatttcccgctatttttttatgtggcggcgtattatttgggataaaccatatttcatctaaatgaagcttttttctaacttgctcagccattgataagtgagctaaatgaactgggttaaaagttcctcccataattccaatttgttgggcagaactcgtaaccggttcaaattgtacttgtggtttttcttttacaacacattgcattatattaacgctcttctaattcctaaaccaattccttctggtgtataagcttttactacaacattagcaggtgtggtaataaacccaactccaccaaataaaatatcgcttttttcttttggtgaaaaagtttggccttttaacggtccgagattatcttctttacttggtgggagtaataaatcatctttatgtttttcataaaatacatctgcattttcagtctttgttctgtgtacataaaggtcgcgtgcaacataaattgtaaatccagcagatggaccatctacatagtcaaaacgtcctaatccagctaaaaagattgtctgtccaggcaaaagttggtaggttgctggcttcaatggcttctttggttcaacaacttcaagttcttttccacttaaatgactagccaattgattggcattcaaaattccgggtgtgtcaattaaataatggccattggaaagtggaattttaatttcatctaatgttgtcccagggaatttagaggtagtaatgacatcctttaaatcactgttcatattgataatcgcgttgattaacgtggattttccaacattggttgttccaacaaaatagatatctttcttttcgccttttttagctaaaaatgccatcaactcatctaaatttttctttttagcagctgaaaccaaaaatattttttctggctttaagccatttcgattagcttcttggcgcatccaatctttaattttggattctttagaattttttggaaataaatctactttattaccaactaaaatatattcattgccaccaataaatcgcttaattgaagaaattaaggagttactaaaatcaaataagtcaaccacattaacgactaatgctttcttttgactaattgagttaagtaaagccaagaaatcgtcgttattttcttcgactggcataatttcattatagtgtcttaatctaaaacaccgctgacaatacacctcattatcatcactctctagtgccttttttaaggcagaagatggtaaatagcccgactttttagggtcttgatcttgtaatatacttccacaaccaatacaacgtaattcttcactcattctaatttctccttaaaaactacaggttttcttaaattcaaaaagaaaaagataaattttctcaaagaagcggttgatccttgtattccacttatcagtttcaactaatggttttactaaaactgtagttacaccagctagatttccagcctgtatgtcagtaatcaactggtctcctaccattaaaacttgatccttttttagattcaaggcttttaattccttattaataccgatgggcaaaggcttgcgtgcttttgcaataaaagaaatatggtatggattcagaacttttccaattcgctctgcattattatttgaaataacaactaaacgaattccgtctttagccagccgttgattaagttcatccatttcaacagctgtctctgctttattccaagcaagcaatgtattatccaaatcgctaaacacagctttaattcccatcttctttaactgttttggatctaaatgatagatagtatctattgtataacgaggtctaaataacattaaaaaatctccacttttttctcatatctatagtatcagaaatctttaatctttagaaacatttgatgattgaaaaattaaattttacttttctttgacagaaaagatggtaaaatggtaacaatttatctctctaccgtattacataaaggagttaaattatgaaaaattttatcgatctccatctacatttagatggttctttgccataccctacggttaaaaaattaatgaaaattcacaacttttcaagtttaactgaagcacaactcaaagaaaagctatctgtctctaaaaattgcattgatttacaagagtatctaactaagttcgattttcctctactatttttgcaaactaagaaagatctagaaacagcgatttttgatcttttaaaaaatttgcgttctcaaggactagtctacacagaaattcgatttgctcctcagtttcacactcaaaaaaagctcactcaagaaggagcaattagatcctgcatttcaggactaaaaaaattttatcagtggcaagatgcgcaacaagacaattcctaccctctacatgcaaatttaattctttgtctcatgcgtttaccacatcgggaccaagaaaataatttaactgtcaagttggccgctaaatatagttcccaacatgttgttggacttgacttagctggtccagaaggtccgattcctaataaagcttttagttcattctttgaagacgcaaaagaaatgcatgttccatttacaattcacgcaggagaagcagctggccctgaatcaatgcaagaagcattagatttaggcactaaaagaattgggcatggaattcgctgtttagaaagtgagcaaatggttcaatatttagttgaccataatatcactcttgagtgttgtgccacttctaatctcaacaccaaaatttttaagaaaattgattcctatcctttaaaaactcttctttcaaaaaagataaaagcaacactaaattgcgacaatatgactgtttcaaatactaacttacctaaggaatttaaattacttgaatcaaaaaccggtcttactaaattagacgaacatcaattattattaaattctattaacgctgcttttgcttctgatcaagaaaagaatcgcttattgaccatatttagctaaaattgagaaaaaaatgctccgcctaagcggagcattttttaatattcttagttcaaagctttcttagcagcatctgctaaatcagcaaaagtcttttcatcgttgtaagcaatgtcagctaacatcttacggttcatgtcaataccagctactttcaagccgtgcattaacttagagtatgaaagaccattttgtcttgcagcagcgttgatacgagcaatccataattttctgaattcgctcttacgcttcttacggtcacggaaagcatatttacgagaaacaaatacttgagtacttgctgctttaaattgtaagtgttttgagccacggtaacccttggctaacttcatgatcttcttacgacgagcgcgtgttacggttccacctttagttcttggcatctaaaattcctcctcaaaaagtcttctaataattaacgcatttgggaaagcatctgtttgatgcgctttaagtcacttgctgaaaccatagcagcttttctcaaatgacgacgttgtttcttagtcttaccgtggaaacggtgtccagtgtaagcatggtgacgctttaaaccaccattagcagttctcttgaaacgctttgctgaagcgcggtgtgttttttgctttggcatatctattcctccaattaactactttttctttttatctttctcacttaatggagcaagcattaagaacattgaacggccttccatctttggcttagtaactacattagataagtcactagcttcgtcagccatcttttctaagacctgtttacctaactccttgtgagtaattgcccggcctctaaagcgaatagaaactctaactttagcgcccttggtcaagaatttacgaacatgctttaacttggtgtcaaagtcatttccttcgattgttggacttaaacgaatttctttgacagccataaccttttgattcttacggttttctttggctttcttttgttgttcaaaacggaatttaccgtagtccataattctagcaacaggtggcttagcattaggagaaagcaaaaccaaatcaaggtcagcgtcagctgctttacgtaaagcttcattcttggatacaacaccaacttgttggccatcaacgccaattaaacgaacttcacgagcacgaatatcttcgtttaagatcatatttcttggtatgagtattcacctccacgttaatttcgaggacaagaaaaaagcgggcaaagttaacgcccgcttttaatcaacagatattatcgatcagcccagaggtaatattaacttaggcgagaagcgggagcttcttcttgttctcaacttctaaattataccatctaattaatttacgtcaagaactaattaaatgcaactattctttttagtgccgattaaactctggtgataaattcatcaatcgatcagcattttcttctaacacctctcgccttttaccatacatcatccaaactgtaacagctaatggaactaagaccattagaacttcagagatataatctgtagcccaactattgaattgccagcctgcagaattccaaccactttgcaggtttgcaaggtaatccatcaagaagtgaaaaatcattgggagccaaagtttcccactataaaggtaaagcacggcccataaaaaaccactttccattactccaattacttgagcaattgtagcttcaaaggtttcaccattccaaccaacgtttcctagatgagataatccaaaaagaagcgcagacccatagatagctattggtacacgcaaatttcgatattgattaaagccagcaagcagaattataatagccaaatatctttcagtttcttcaaaaatgcctggttctaaagcagctgtaaagcttgcaatagtaaaatattttttctgcaaatcaattgaatacctaaaaaatgcagtccatatttgcttatcgtaattaataaaggcattgtaaaacacatcaataaatgcaaacaatactagtaataataagactgaatattgaaaatttctgctttttacaaacttcaaattaggattaaagtgaaacccccatgcttttcctaaaaagcaagctaaaattaataaagcaaacgctgcaactacgccttggctagtaattgaatgaagccacggtaaatttttgccaatctttaacaaagaatcaggtccatactgtgttcctaggagaccaactcctattaaacgtaaaaaccaattctttaagctacccgcaaacaaaattgcgaggggtaataataaaactaagtagctcatccatagtaaaagaacccacagaatttccagctgagggacattttttaagaaataattacctatttctacccacacgcttgggaataaagtacttagaccaaataaatttagccatcttacaatttcaaaaattattccattctgtctatttaccctttgattatagaaattaagtccaagaacaattataaaaaaagctccttgaattaaatttcctacactatttttattttggaaaataacctctaaaagcatccagataagtgcaattaataattgcacatcaaaaatttgttgccatcttttatgtgacaaagtaaaatccttcattctattcctccagttagttatctagtttttttattataatgatctctcaatttttttaaagatatttcatgcataataaaaagaactcatctgctgtgagttcttaaaaactaatcaaattttactttagtctaaaattacaacttaaaatttcgttctctatttagatatatcagcaccgtcttcatttatttcttaactctgcttttactctttatttttcttcaattgaatattgatttgtctcacttcattccacaagtgaaaaaagtaaactccatatgcaagagcatacatcagaataaagtttccgataataatggctaactgcttttccataactgttaagccatctacaaagaaattaaatactaaccaagcagttaagcaaacaaaaaaattaatgataatctgctttcttaatgaccaactatcattgttaaaaatccaacccgctaaataaaaaaagattccaattaaaaaagattctaatatccaaaataaaaaatctgagattttaagtgtactattagctaaattgttccaggaagactgcagaagaatctgaacaactatccaagtcatccctattccaattccaattaaaccacttactaataattgaacaacctttttcataatcctaacctctctttcaaaactttaatctttcttcttgcaacttgaatgcgtaagccattttctaaaattgcatcaatatttccgctactaacaatttctaaatgatttatagaatgatagttgacaatcgaacttctggaagtagtaacaaaatcattaggtagaagtttttccacttgatacaatcttcctctaaaaatgtaaacatctctttctgtacaaatcattgttttttcattctcaacttgaatagcaaaaatctgtgaaaactcgatcatataagcatctctatttttgtagccccaaagaaaatcttgctttgatgttaattcattcgtgattcgctttattttgctagtcatccttttcaaccaaaattcaactttttcttctggtagattaggatcaatcttaaactcaactttcattaatttccctccttacttggttattaagtatagttatttaccgcttgaaaaccagagattttcggtaaatggtcttaatctaacggtgaatggtcatttttctatacaaaaaatccgctaggatcttctcttttccctagcggatttttattatctatcaattatcaaaattatttttctcttgagtatgacttaacatctgcatcaatttcagcaataaagtcatctaaactcttagaaatttgttcttcagtaccgtagcgacgaacattaacaccgtttgcgttcatttcttcatcaccaagaactaaagtgtaaggaaccttttgagtttgtgattcacgaatcttgtagccaagtttttcatttctgtggtctacttctgctctaaatccgcgcttagctaattcggcacgaactttatcagcatattcaccgtgagcttcttcattaactggaataatttcagcctgaactggagcaagccaagttgggaatgcacccttgtaaatttcagttaagtaagcgatgaatctttccatagtaccaacaataccacggtgaatcataactggacggtgttcttcaccatcttgaccaacataagttaagccaaatctttctggaagcatgaagtcaagttgaatagttgacatagtttcatcattacctaaagcggtcttagtttgaatatcaagcttaggaccgtagaatgcagcttcaccttcagcttcaacgtagtcaaggccaaggtcatccatagctgctttaagcattgattgagatgtttcccacatttcatcgtttgcgtagtacttatcagtgttctttggatcacggtaagaaagtctgaagtagtaatcagtaatgtcaaagtccttataaacatccatgatcaacttcaaaactttagcaaattcttctctaatttgatcaagtgctacaaaagtgtgtccgtcgttcaaagtcatttcacgtacacgttgcaaacctgacaaagcacctgatttttcgtatctgtgcatcatacctaattcagcaatacgaattggtaattcacggtatgagcgaatgtggtgcttatagatttgaatatgtgatgggcagttcattggacgaagttcaagcatttcgccatcacccatatccattggtgggaacatatcatcacgatagtgtgcccagtgaccagaagtcttgtaagcatctacgttcattaatactggagtataaacgtgttcatagccatcagctacttctttatcaacgatgtatctttcaacaacacgacgaatagtagcaccctttggcatccagtaaggaagacccgcaccaactttaggatcaacaaagaataagtctaagtctctaccaatagttctgtggtctctttctttaatttcagcacgacgctttaagtcttcatctaaagcagccttcttgaagaatgcagtaccaaaaattctttgaagcattgggttagaagatttacctaaccagtatgcaccggcaactgataaaagtttaaagttcttaattttaccagtgtttggtaataaagcatcaaagccaaagtcaacaaagtcacctaacttgtaaaccgcaacttcgtcttcttcatctttcaaaagatccaatttgaattggtcatccttaaagatttcttccaattcactcttcttcattgaagtatattcaatcttttcaccattcttaatggctttttgcattgccttttcaagatctggtaattcagtaaccttaatttgatcttctttatcagtatctacgaagaaaccaccttcgtcagcttcgtgcatccccaaacgtaattctgggtatttgcgctttgcaacagcctcaagtaagaatgctgcagtagcacgtaaaatgtctaagccttcttcatctttatcggtaataatagctgcttctacatcttcatcaacgatgtaatctaaaggtttcattaccccattaatctttgcaccaacagcagcttttcctaaagaagtagcaattgaagatgctaattccttaacagaaactgccttatcaaaatctttcttagagccgtctggcaaagttacagaaaaactcataaatttttacctccaaataaaaaatcccagcactaaaaacagtgctgggacgttaaaatacgtggttccacccgaaattcgaattaattacaaaattaattcctctaaaggtcgttaatggtacctaaccaaatataaaaaatttcaggaatgaaattggggttttcttctaatcaggagcttccagaactaggctcctgtctctgaattgaagaaaatcatgtctttcattgactttcattatactagctcatcaaatagatgcaagcaaaattttaaaattaatttcgacgatttttaccgccaacaaaaacttctttactcaaaaaacgaactcgttccatcaaacgccttgccttaacttcatcaacgctatttctagtttcggcaaaatgttcatttaagccgtccattgttatattcgaactaaaaaatgttggtaaaacattatccatccgcttttgtaaaatcacacctagtatatcgtctcgtgaccactcacttaacgtttccgctccaatatcatcaaaaattaaaaccggagctgaagaaatgcgatcaatctcatcgtttaagctattatcttggaaatggcttcctaaactagcaataaaagaaggtacatgcagaaaaactactctactgccttgccttgctattgaatttgtaagtccagctaaaatatatgttttccctacaccaaaatcacctgttagatacagtccctttatatgcttattttttttaaattcagctaaaaacattgctacttcattcaaggcattctcacgttcaggagttgcatcaacatttgctaattcaacatgacgaagcttagcaggtagatcaatcagttcaattctattttctgcgcgctttttagcttctaaatttagttttgcttcagtagggacataggtaatatcaattacttttccattaagaaaaagtttaggtgtatatccctccatcactggattgggtgactcaatttgttcaacatagttgaaaattgtaggaagggatgcctggacaatttctttattcaatctttctttattctgtgcgagaaaggcttgaacttttggatgctttattgctgttttagcaatttttttgctatcttcacctaatttgcgtttctttataattcgtgtaattacttcagaaatatcttccaccagtacaacacttcctattcatttttaccaaattctcgaaaaattcgatttctttcttcagcagacatcgttgtttttttagactgatttttcttctcatactttgaccagtcagttgtattgcggacagtcttcttctgagtacgataagatagacgtttgcgcttattcttacgttccttaagatatgcaattgcttcagttggtgtagtaattcccttttgaagccaatcattagcaattcgatctgctaaattattagttaagactgcatcatattcaaaacaagtatgaactattagattaattaaaggcggtgttaaacccatctgatcctgcaaacgataaataactttcttttcattagcagttacatatccgccctttttttcttttaactcatataggtaatcagtgggagttttactatctactgctcgaatcaactctgcatctgctgttgacaagttcttaattgttttatcggcatccttaggcttttgctgcaactgttttctaaccatttccttatttcgattaaggccaaagttttcgttaacagcattttgaattgcatacatatttaatttatctgtgcctgccgacatagtaattaaagaagtttccacaaattcttgttctgttaagtgataaaaatcaataatttgcttgatttctacctgatgctttaaaacttcttctttatcaatatgataacttgcaaatagatcgaccaaaaaactccaatcaatcttcacaggctcatttcctagctttatttcacctttattatctttaggaacttcacttgctgcttctttaacttcgataggagcgtcaattgcactctcagcacttagatgaaatacgtcaaaaaatccactagtaacctctttagcatcctttagaccaataaaagtgcgcggcgtgaattttttgaccaagcgattaaaagttacacttcctactcgttcaagtaacaaactagacaacaaaaatgtatgaaaaaactcaccagctgagggaaccttttccacttcaaaaattaacgtttcccctaaaacaggatttgatcctataaaagtcttaatcaaccctgttgcttctaaatgatgtagggtggaaaacagatcttctagttttagatttgtctgatcttgaagttgatacagagttttataatctttggcaaacggaacttcatcaaactccttagtcaaagttatatacaatcctactccttgtatgcctacaaggggttcaaatagagtagttaagactcttatattttcttcactaacagctacttgattagccacataaaaaggctgtttaggatcagcactttcaaacaccggctacctactccttatcatgcttagccatcatatcttccatggcttccataaatcctgaaacatctttaaattgacggtaaatacttgcaaagcgaatataagcaacatcatctaaatttgctagctctttcatcactagattaccaatatctttagatgaaatttcattaagaccttgcttacgaatttcattttctacatggtcaactaaagcatcaagttgttcacttgaaattggtctcttttgtgcggccatcattaccccatgtaaaattttatcgcgattaaatgcttcacgggttccgtcatttttaactactaataaaggtgaacgttctactctttcaaaagttgtaaaacgaaaaccacaattttcacattctctacgtcttctaattgctctattttcatcacttggacgagaatcaattactcttgaagcatttttatgacagtttggacattccatttttttacctgcctatctcttgtaataaatcagataattttttctctaagtcacctattgtaccagtattagctactacataggtagcccttttttctttttcacttaatggcatttgattacttattctagctacagcttcttttttagtgaaggcatttcgtttcattaaacgttcaatctgcaattctggtgtaatagaaatagccaaaacaccattacataaactttcaaagccagattcaaacagcaaaggcacatcgattacaactaatttttcttgatttgcacgatatcttgccatttgttgtttaatttcttggtggacaagtggatgtgttaactcattaagttttttcaacttagctttatcgttaaaaactattccacctaacttacgacgattgatcgtttgatcatcattaagaatatcggtaccaaaataatctactactgctttgtagccattttgcccaatctccattatttgatgagcaatcaagtctgaatcaataattggaatttttttctttttaaaaaattcatcagctgtacttttgccactagcaattccaccagttaaacctaaaaaatatgtcatttgtatagcacctgacaatgcggacagaaagtagttccgcgtccatttactttaattttctctagaatagtgccacaattattacactcttcacccgcatgaccgtaaacctggagcatattttggtaaccacctatatcaccattagcatccaaataagtatgtaccgtagtaccgcgctctttagttgcaacagtaatcgtatgatttatattgtgatataaatctactatcttgtcagcaggaattgacttcgcactacttaagggatgaattttactctgccacaatacttcatcaacataaatatttcctaaaccacaaactacggtttgatctaaaagagtattcttaatattcttcttctttcgacttagagcattaataaagtattctacactaaactcttcagtgtttggttcagggccaaggtgccgaattccggtcgtctgcttctctgttccagtttctactagatgcattcttccgaatttacgtacgtcagcatagcgcagagcagttccatcagtaaaaacaaattccacatgctcgtgctttcctttaggatgatcaggagtcactaaatgatattttccttccattcgtaaatgggaaaccatagtcaggtcatcgctaaatctaaatagtaaatacttgccataacgatcaattttcaaaatttttttattcgttaatttttcaacgaattcgtcaggattattaactataatctttggataccaaataataattttagcaattgtttttcctttaactaaaggagttagcgttcttctaactgtctctacttctggcatttctggcattgtctcacctacttactgtttattttgcatcgtaccaattatgtccccaatttgaatctgcaattagtggaacatctaatttgacagctgactgcataacctctggaacaattttcttaattgtatctaattcatcttttggcacatcaaaaatcaattcatcgtgtacttgtaagaccattttagtctttaaatgtagttcatcaagttttttctgcatattaatcatggcaatcttaataatatcagctgctgatccttgaattggagaattaattgcagttctttccgcaaaacttctgacattgaagttctttgaatgaatatctggtaaataccgtcttctatgcataattgtttctgcatagccattctcacgagcttttttaattgcttcatccatataatttttaatttgaggatattgttcaaagtaattttcaataaaagttttagcctgcttacggctaatgcctaagtttttagacaagccatagtctgaaataccataaacgataccaaaattaacagctttagcatgtctacgcattaatggcgttacttcatcaggtgagtccaagtggaatattttcattgcggtgtgggcgtgaatatcatagcctgacttaaatgcttcttgcatatgttcatccccagaaacatgagctagcactcttagttcaacctgagaataatcacaagagaaaatatacccatcttttgttgaaggaacaaaagcttttctaatctgctttccttcctcagttttagttggaatattttgtaaattaggatcaactgaagaaagacgacctgttgtagtcaaagtctgcaaatagcgagtgtgaattcttccatctggctgaatgcagtcaagcaagcccttaacataagtgttttgaattttagcaatttgacgatagtccaaaatttctgaaacaattggacttttcatttttaattgctctaatacttcaacagatgttgagtaaccagtcttagtcttcttaattggtggtaaacctaatttttcaaataggatatgccccaactgcttaggtgagttcaagttgaattcttcgccagcctgttgataaatcttatgttctagttcttgtaacttaactgcaaaatcattacctaattgattcaaaacggatgcttcaaccttgattccagtaatttccatctttgctaagacgaaagccactggaatttcaattgtttcatataaatcatcttgttcatgatcttttagtttttcaagaagtggagtctttaatttctcaattacggcgactttagctgctaaatgttcaaagaaatcattatcgtcaggtacagcttgttttttaccttttccgtaaacttctaaatcagtctttacagaataatcgtcatataaatgagctatttctccaagatcattcgaattattttcattattaactaaatatgaagcaagaagcatatcatagtctagaccttctgccttgatatctagtcgatgtaaacctacatacgttcttttaatgtcaaaaacattcttcttgatagtcttatcttctagcatttgacgaagtgaattttcttgcaacaaaactggatctttagatacataaatcttattaccaacttttaaagaaaagccttcaattggagctagatgataattatcacctaacattgctaaataaaaagttacttctttttcactgattttatctagctcaatgatattttctttagttaactcaagatattcatacttttccgtttctggtgtgttactagttgtaccattaacatctaactcagctaagaatttcttaaatcctaaacgctcatataaattacgcaagtcttcaatatttggttcttgtaatttagtatcagctagagttacttccactggcgaatcacgatcaatagtagctaatttttttgctaaaaaggccttatctttatcattaattaagttctcttttagcttagactttttcatttcgtctacatgttcataaagttcttcaatagaaccatatttttgaattagacgagaagcagtttttgggccgaccttagttacaccaggataattatctgaactatcccccatcaaagctttcatgtcaatgaattcagttggagtaacaccgttaacttctttcatatgggctggagtataagcttctgtatcgccaactccgtttttagtaattaagactgtggttttatcagatgcaagctgagttagatccctatctccagttacaatatcaactgtatatccagcgtcttctcccatcttagaaagtgtcccaataatatcatcagcttcataattctttagctcataactctttattccaagatctttaagcatttcacgaattacaggaagttgctctgacaattcacttggcgttttttggcgaccacctttataatcttgatacatctcagttctaaaagtaacttttcctgcatcaaaagcaactaatacattagttggattagtctgcttcatgattgcgtcaagcatatttttaaaagtaaaaattgcatttgtatgcaatccatctggactagtaaaacgatcaagctgacggtataaagcataaaaggcacgaaaggccacagagttgccgtcaattaaaagtaatttcttttgtgccatatttttctccttagataaaaaaactgtcaaattagtctcttaactattttaacagtttttcttctatgatttaattatctactttgctttagtttgctctcagattaattctttaccactataaagaaaaaaggaatcacatctctgctataatgtgattcctatgatgaatgcttaagtaaaaaataattattaggggaatatttttacttagattctacttttttcgtgaaaatagttactttttgttgataatcatctatcaacaaatttaaattttgtcgacctttccattgtccatagccaaagatcgacatgcctaaagatcctaaaacaaatagcactattcctataataaacaaccaaagagttttagcgtgaaagtaataaattaatacaacaccaattgcactaatcataaaaaataaattaaaccaagtttttagattttttaacatctttttttggtaattaacttcgttaacatagccttttcttaactcttcaattgtcattataagatctcctccaagattctacttagtatgataaacctgggttgaagaagccaaccaatacacctaagagggcaactccgattaaaataatcatagtccaaatagctgaaacgtgtttcttagccattaaccaccagcataagaaagtaacaataacggtaagcaaaccaggataaatattatccagctgcttttgcaagtccatgaatacacgaccacttgagtcacgtaatttcaatgatgttgtaacacttacccaacttgcaagaacaccaccaactaccattccaccaacaattgaaatagctttacgaattgctttaccttgagtaccaactaaaatatcaaccgctttatcacctagtttatagccacggaagtataagaaacgttgaccaaagtaagcgattaaactccaagctataatatagaaaatcgcaccaactggtgaaccatttcttgacatccctaaagcaatccctaaaagaattggaattaaagtaccatcaattaacgagtcaccaataccagcgataggtcccattaacccagcacgcatgtcattgatagtttcaccgtcaattcccttgccgtttgcacgagcttcttccaaactagcagtcgtaccaataataactgaacctaacatagggttagtgttgaagaaagctgtatatgcatgaatattttcttgttgttgttttttatctggatatagttctttaataattggcaacatagaagctaaatatccaaatgtttgcatttgttcctgtgagaaacaggttaaagcaccccagaaccataagttaaaggatttatttaatgttttgtgactaatctttttctcatccattgttaaatatcctcgtcttcctcatcgtcatcatctacagtcgtatttgcactagtagtaggagcagcttttcctttgctcatttcaatttcgtacataattacggcaaatagtaatgaaattacagtaattgatactaagttcagctttaatgaagcagctaatgtaaaaccaaccaagaatggaataaagtctactgacttattaacaatctgacgaagtaaaatagcaataccaacacatggaagcatagcaccaacagtaaacaaagtcttcattggaatgccatccataggaagggcgttacgtaatgcagtgacaccttgtgcaccaaagtgagtcattaaaacagttggtaagaatgagaagatcaagtgtgaaatccatggccaaccaaagttaactgcgtataatctatctaatttattattttcaatatccttccaacccattgattgccaaaccaagtttaggaatgcaactgagtaaaacagcactgaaccaatagtacccaccaaagtacctaatgacttagccatattagctgcttgactactaaatgggcttaatcctctagaactaatggcaaccattgctaaaggaataccaatataagaaatcgcacgaacatcagctgaaacagtaccacctggagttaccaaagcgatgtaaaccaattgtgttgcaacaccacaagcaattcctaatggaacgtttcccattacgattccgcagattaatcctccgactaacggacgaccaatcatgtagttaccaatagcttgaccagccatacaagagtttgagcacaaacatgctaacagaccaaatatacaggcttgtaaccaacttatagtcattttttctacctctttacctatacttatgacttatattttaataaccaaacttgcctttaaatttgtcccagtaaccaatttgcttatcaggaagaagtgcaaagtgaatcttataacctttatcagccattgcttcaaaggcatctccttcttcttgagtaaatgattggttatctcccaacttaatagcacctggccgatcatttcctggtccaacaatgacttcattcacatcacttggtttaaatccccagtcaactaaaatagttttcatatcaagaggattcttagtaattaaaaagtaacgcgtatttgaagctaaaaccttatcttgaactttcttaaaatgatccattgtccaaacaaagcattttttgccttgaccttcagctgccgacttataagcttcttttaagataggattatcatgggccttatcatttacagcgataattccatcacatggaacttcctttgcccaacgagtagtaattaagccatgaatcatacggtcatcaattctaacaagtgatacagtcatttttatttcctcctaaatatcgtcatcatcgtctgtgttatcttctggtgtaacttcatattgcttcaatgcttgtctagcttcatctaaagcattcttagcaatatcttctttactcatcgtgtctaaagaaaccgttgcagttaaagccatagtaaagttcattccacctagaacaacacctttactcattaatcctctttcagaaaaaacacttaaaaatgttgttagaggacttccaccgattatgtcagctaaaattacaaattcatctttagaactaaagttatgtttctcgaagaaatcattaacttttttcttaaagtcatctgctgattcaccattgtataggcacaatgtatgcactctttcaattgcatccccagcaaacatatctaatgaagttttaagaccttcagcaaatttaccgtgagaaactaaaattagatttttcacttttacaccccttctcttaattacagttataatttatcattatgaaagcttgtacataagtgttaaatgtaatcgtttactgcgtaatgaatatgacatttgtcacatttttactgcttaacttattttttaattttttataaaatatccataacatgatttgttttataaagtagttaataaagggttaattatgaggaaaatatttataataagcagaatcatttttccaatatttgtaattgggataattatctatctcttctatgcacaaccatttagtcataaaccaattaaatttggcagtacttatatgacaatgaataacgatttttatcaaaccttgaatgaaccaattgctaatgaagtagatgatcataacgaccttctctataatcgaaatccagaactaagtgttaataatcaaattacagaaatagaaaattttattaaaaatggggtcaaagttatttttattaatccagtcgatggtaactctccgagactaattagagtattaaaaaaagcccatcaaatgggcattaaaattattgtagttgatagtcaactcaaagattcaaataattatgtagactgtactgttcgatccaataactaccaagctggagtactttgtgcaaaagaattaatggcaagacaaaaaagtgcaaatattttagttttacagcaaccaactgcaatctctgttgtagaacgaattaagggatttgaggatacaattaaaagtcatccaaattttcagattatagatagaatcaatactactggacaatcggaaaatagttatccaaaagtacagcgctatcttagcgaagaaaaaaaatttgatacgattatgtccttaaatgacaaaactgcagttggagctttagcagctattaattcaatcaattcaaataaagaaattgctatctataccattgatggttcagaaaatattaaaaaaatgattagtaataaaaatcctaatattaaagctactgtggctcaatcaccactccaaattggtaaggttgctgttaatgtagcttacaaacttcttaatcatcaaaaagtaaaaaaagaaattattctacctgttcaacttatcacatctaaaaatataaaagattttaatattacggggtggcaataatgaaatttaaatacttagtaactatgcgtcacttcgtgatagctttaaattttattattgtttcttttattggcgcacaatttttactagttacccaatatatccttaatcatcaactaagttcagaactcttaactacgttagctcaagttcccgattcgccccttaccctatttagtgaatgtatcatttcctatggtttattagtgctagtaatgtatatccactatcattataatttttctactcaaaacaccctattactacttgttcttgaatttatattagctttcgtaatcttttttgcagttagaatgaattataatgggatctttttattaattttcattgacctattattaacttatcgaaacttaccaactattcaaagctattggttttggggaatctcaggaactatcttcttactgttattttcattttcaaattattctcttttgggtgttttctttaagatgcctagtctgaacacatatcttgattttcttcctactcaatctcgctcgcttctagttttcttcaataattttcttgtctcattaaacctaattacttttatctccatctgcctcggctacgtaatttatattttaaatcggactcacaccgttcaatcaaaattacatagtatgcaaaaagctaatgatgagcttaaaagttatgcagcaatatcggaaaaaattgctcaagatcatgaaagaaaaagaatcgctagggatattcacgatacagttggccacactttgactggtgtagcagccggaattgatgctgtaatggttttaattgatattaatccagaagctgctaaaacccaacttcaaaaaatatccactgcagttaaacaaggtataaaagaagtgagacaagttttaaatcaaatgcgtcctgatgccttaaaaagttatactttagaatctgcattaagtaagatgttgaaggaatacagcgatatttctcatataaagattgagctcaattatggatggggaaatgcgaactttcaaaaaactactgaaaacattatttttcgtgtcatcgaagaaacagttactaattccctgcgtcatggccatgcaacaaaaatttggattaaatgtaccagtaataactcttcttatattctctccatgcataataatggtaaaagtgagacacacatcaaaccaggttatggcattacacaaatgagagaacgactcacaattatcaacggcacagttgagtttgatggtaaaaaaggttttactacagttgtaaaatttcctaaggtaggtgtttaaaatgataaaaatactaattgccgatgatcaacaattaattagagattcaataaaaataattctagaaagcaatgatgatttttctgtaaccgacacagttgctaacggtaaagaggccttaaatagtattgaaaaaaaataaaccagacgttattttaatggacgttagaatgcctgtaatggatggaacagtttgtacaaaatacgttaaagaaaaatatcctgatattaaagtgataattctaacaacatttgatgatgatgattttatttttagtgctttaaaatatggtgcttcgggatatttattaaaaggtggttctcctgctgatttatttacagcaattcgcacagttgcacaaggcggagcaatgatcaatcctgatattacagaaaaagtatttagactgttttcaaaaatggcgcaagcaaattacacaatctcagtaaatgaccaggaaactaaggacttttccaaaagtgaatggtgcgtaattcaacaagttggcctaggtttatccaataaagaaatttctactaaactctttctatctgagggcacagttagaaattatatttctaagattttagagaaattaaatttacgtgacagaactcaattagcaatttgggccgttcaaacaggtgttactagtgaaaatatcgataaaaaatagcaaaataattgtctgcactataatttttatcactttattattggacgtatttctcttctttaaagttaaatacagtagaccagtattaaccattggggtttacacagatagtagctggaatgtacctaatggggatgcggactgtgtaactaaattagcaattaagaaatttaaaaagaaatatcctaatgtgaatattcaatatactgctggaattagaaaaaatgactataataattggttaaccgaaaaaattgttaaaggtaatacgccagacgtaatcatgttaccagaagatattttcaatttattagcaaataatggtgctttaaaatcattaaataatccattaaacgacgacaggatttctcattcaactttttatagtagcgtgttcaaagcaggccagtatcataatgttcaatatggtcttccatacgaaaccaatcccaccttaatgattgctaacaatgatttattaggtaaaaatggtttttctaacttgaattggcacttctctcctaataaattaaaaaatatttgtcggacaattaatataaataataattatgctggtattacctcagattacacttggcaagatgcacagctggcttacggtaattccgtttttgaaaattcatctattaatcttacttcaaataaagcgcgtgcaggtttctcattaatcgaagatttaactaataaaaatggttatcaatatgtcagttcaaatcaatttgatgaaggaaaagtgggttttatgccactatctttagctaagtatcgtacctatacttcctatccctatcatgttgcccatacatctaattttaaatggaaagtatttcaaatgccagctattaagaaggttaaggcaactcctgcatcaaccgtttgtttgggaatttcttccaaaacagcacaccctactctttcctggaagtttattaaacttatgtgcactgacaaagaaatacaacaagaagtattaagaagcagaatgggagcttccgtcttaccacaggttattaagagtcgttatactaaaaaaatttttaaaggagaacagcaaaatcagcttactcctaatatgcttgattcaattctaaaagatgttgcaactacaccaaaatttagaaattatcgtcataaagaagatgaattaaattatctcattcaaaatgcactaaaaaataatcaattgaatcttcaattatttagcattcagcatcaaatcaacaaaaatacttattaataaaaggcggagatgattttccctgcctttttattatttaaattgacaaagcgttttcatagatctactatatatttgcaatatgtaattacatatttgaaagaaggattaaaatgaaatacactattgatgattttgcccgcttaattgaccatactaatttacacgctgatgcttctaatgaagatatgaagaaactatgtgatgaagcgaagaaataccacttcaaaatggtggctatcaatcaggttcaatctaagttttgttcagaacaacttaagaatactgatattgacaccggagcagcaattgcttttccattaggccaacaaaccattgaatcaaaagtttttgatactgaagatgccattaaaaatggtgctaatgaaattgactatgtaattaatattactgaattaaaaaataagaattatgcttatattaaagaagaaatgaagcaaatggttaatatttgtcacaaatatcatgtgccatgtaaagtgatttttgaaaattgttacctaaccaaggaagaaatcaaaaaattagcagaaattgcgaaagaaattaaacctgactttattaaaacttctacaggcttcggcccatctggagcaaaggttgaagatgtaaaattaatgaagtcaatcgttggagacaacgtaaaggtcaaagcagctggtggcattagaaatagtgatgatttcttagcaatggtaagagccggtgcagaccgtattggctgtagtgctggtgttaaaataattgaagctcttaaacagcggatgcaagatgacaacgtaactacaattgagattaatagataaatgactgaagcaaaatataaaaaaattgaagctattttaaaacaaagaattatcgatcaaacctatcctcttaatagtttattgccaaaagaaattgaactagctgccgaattcaacacaagtcgcccaacaattaaccatgcgattcacaatcttgttcaacaaggattcttagagcaacgtaaacgattaggtactattgttaaaagaaataagattgcacaagaatttactcacgtaatccaaagctataatcaagaaatgaatgataaaggattaaaagcaagaactaaagtgatctcttttgataaaattaatcctacttcagaaatacaaaacgccttaaacttatatccttctgactcagtctttaaattagttagactaaggtatgtagatactactccaattgttaaagtgaccacttatatccctgctaagcttgttccagagctagataaaatagatttttcccaagtatccttatacgatgaacttaggaaaagaaatttaccggtcacccatgtcacaagaaaattagaagtgaaacaagcttcttcaactatatcgaaaactttaaaaattaaagaaaatgatcctgttttttattttcatagttatggatatgcaaaaagggatcaaaaaatagaatactcaattgccacttatcgtggagatttgaactcgtttattattgatcttaatcttaactaaaaaggattgattaaatcttttactttactgcaaaagtctaatcaatccttttatcatatttcaaaatatttaattaaagtaacttttcataagcatcttcatacttaggaatatcaccagcacccataaatacaacaactgcattcttgtgcttagttaaatcagcgatgttgtctaaatcaattacttctgaaccaggaatattatttactaaatcttcacttgaaatatctccacttgcttcacgagcagatgcatagataggagtaacatatgctttatcaacatcacgcaaaatttcttcaaagtccttttggtatttcttagttcttgagaaagtatgtggttggaaaactaccactaattctttatctgggaatttttgacgagcagcttgaatagttgcgcgcatttctgttgggtggtgagcataatcatcaattacggaaacatccccaaaatctttttcggcaaaacgtctttttgcacccttgaaagtaagcagaccttccttaatatcatccattggaaccttttcagtataagcaactgcaattacagcagtagtgtttaaaatactgtgatcaccaaataagtgaatttcaaaacggccaaggtcttttccatgtgctaaaacattaaatttagagccagtagttgtcttttcgatattaactgcttgaaaatcatcagtatccttgaagccataagtatacttaggaatatcagtctttaaactttgcaaacgcttgtcatctccccaaacaaagagagccttcttagtttgatcagctgcagtttgaaaagcactagtgtaatcatcttgatccttaaagtaatcagggtgatcaaagtcaatgttagtcataatttggtaatctggatgatatgccaagaagtgacgacggtattcatcagcttcataaacaaagaaacgtgagccctctactcctttaccgcgaccatcaccaatcaagtaagaagttggtgcaacttcacctaaaacgtgtgccaaaagactagtagttgaagtcttaccgtgagtaccggatacaccaattgaagtatgcatctgtacaatttcttcaactgtatcaggatagctttgccattcaacatttttgtctaaacatgctgctacttcaggattatcttgtttaaaagcattccctttaacaattacttgttctgcattgctcttaatattggccggatcaaaattttttacttcaataccagctttttcaagaggtacctgagtaaacgtatatttttcaatatctgaacctgcaacgttataacctaggtcatgtaaaactagagctagggatgccataccagttcctttaataccaatgaaccaaatttgtttatttttgtctaacatattattaatatctccatagtttatgccaaaatattcgctttaattctaccatttttagcacaaaaaaagaacataacccagcgttatgttctaattagaaagtagttagctcatccttactccctactttctttaatatttattaatctgtaataaactatttatcgaaccctaaaatattacgtcgtcttagatcatcaatccacgccatcagcattcttatgtaggtgataacccaaaatggtaatcatcaaaaaaactccgcatatcttttatacttggccgataagtgaggctatacccccccccagaatttctggaggattggctagtattttgtacatattgcacttcatcattactatcttgctccattattttattcaccatatatatcaaataaaaaaacattattcttacagttttactatatcacttatgatgattaaataacataataaagatagatattaactataattctagatttatttacaggataaagcaacaacaattatgctatatggctatgaataaaaagttttaaattacatattcataagttaattctaaattataatgataattattcttataacaaaacccgaaattcaaatgaatttcgggttttaaaaacttcgttaattagtaatatattttaaagactaatttgaccactagctaataattcatcacacttagttggttcaaattcatcgccagctttaaagtcgtcaggaacaaccataataccacgcttttgaggagcatgtgctaagcctaattcgcgtgctgaacaaatcataccgtatgaatcaacaccacgaagtgcacctggccaaatttgttgaccatttggcattaaagtaccaggaagtgccacaactaccatttggccctgagcaatatttggagcaccacaaacgatttgatgctcttcaccattacccacatcaacagtagttacatgtaagtgatctgaatctggatgtgcttcacaagtcttaacgtaaccataaacaagagttggctttccaatttctagcttagtatcgaagccagctgcagcaattttcttgtttaaagcatcgactaattcttgtgttggtttaacttcaccatttggtaacttatcgtagtctaaaaagctacttacgttaaagaaattaaatccaataacttctccatcttcattttcaactcttgtaacttgatctttctctgtgaacttactacgacctttatcttggtccaaaatcacaattaaagtatcagggtaacttgttttattggtagaaataatcatttctagtaaatttcctttcctagactatttgagagagttaaggaagttttctacttcttctttagtctttctgtccttatttactagtctaccaatttctttgccatcttggtagacaacaaagctaggaattccaaagatatttaattctttggctacatcaattgatccatcacggtcaatcttatagaattttgcatcaggattatctttttcaatttgtggtaaaaatgggtctaagaagcggcaatctgggcaccatgtagctgaaaatagtaatactacttttccatttttggtaatttcttttaacttctcaggagttaattctttaatttcttccatttatctcaccttttcttactttttataagttacaattattttacatctttttatttcaaaaatctagtgtcagatcttttagcttaaaaacgatctacaataaaaatatagaaagagggtattaaaacaatggttgatatgaataaggaattactccacgccggttatcaattacacttagtttttgacgaaatggttcaagagattagaaaagattctgataattggattatgattattgaaaaaaatattgaccaaatttcttcattaatttctgcctatcataaaattgcagctacaattaccaccaatactcgaaaaaatggactacctgtacacttaaaatctgcttcagatgataccttaaaagtgatggacggatttaatgatgaaattcttacttttgataattttgtcgataatagtgaccatatcaaagcctttaccaaattttttagggccgtcaattatacaaacgaattacttctagaattaaaattgcaaaacaaataattagactaaaaaagtgcctaggattaaattttcctaagcacttttttgtcttttcaaaatatttttagcaatttattttacaaaatgtgcatgcaagcagtaaattggattacccttagctgcaaatttatgttcatattcagtctcaacatttctttcaaaaatttcatcatctgcatgatgtaaatctagactcacataatcaaatttcattccataattgttaagactaactaaactgtattcaaacaatcctcgattatctgtcttaaattctaaatgtccctctggctttaaaatttgacgatacttatccaaaaagctcttataagttaatctacgcttttcatgacgtgtctttggccaaggatcagaaaagtttaaataaacaatgtctacgctgttttctggtaaatacattgcaatattagcagcgtctgcacacattaattgcaagttatcgatcttttcttcaagcttagttcttaaaatcatcccagcagctgttgtttgaagttctactccaataaaattcatctcaggatgttctttagctaaagtagtaataaattggccctttcctgagccaatttcaattgctaatggcttagaaaagtcctcgaatctttcttcccagttaattttcttatctggatctggctcatttaaaattacttctggatgttcagctactaatttttgagcccaaggtttatttcttaatctcattttttcacaacctaatatctaacttttttaaataactgttcaattttacttggtaaataaaaatatagcaataagaatgttaaggcaagtaaagcaataattccaccaaatgcttctaatttttgcggagaaaagattattattgctaaactaattaatccccattcaagtaacattcccttttgaagaacttttcgtagagcttgtcctctagaagcaaacggaattggcattacatgatacatcatattatgctcatatactgttcctaaaggaatcaattgataaagggttaagaaaatgatcaaagcaccggtgccaattgcccaacctgcgtcttgtaagcatgcaattaataaaattgcaaacagaatcattctaattaataaattgctatattccggatctcgcaataatactctttggtaaatgaaagtatttggcgtttgatcagttgttttgattaagaagtctaaatattttcttctagaaattcgtactttcttatcaggtacatcagtaaacatactatagaaattatttagtaaatctactcttcgttcttcataatctaatgccttataccagtcaaacatctttccttgtggcaaatagtctactccaatccaagcagcaattgctatcgtagtataaataattggattaggataatggcctaaaaaagaaagatacaagactagaaagttaattcctaggtatagccaagtattgtaataattatatttattaaaatagaaacttctaacaatcaatttaaattgtacattcttactggcgaccaaaccaatcacaataaaaatcaggccaccaattgaaaagccagctctcattgtcgcaaaaggcaataaaattcctgacaccaaaacaattaaaacgaccggtaaaatcatattatgcagatataaaggcttaaaatataccttcatttcattatcttgattaaaaagaaaatgttcatcagccctatcaaacaaagtcgcaaaatgaccaattcccaaagttgcagtccaaattaaggctaaaaggggcttataaaaccaaagattatttggccattttttaatgttttgcgcataccaaaacattaaagctccaaatagaaaaatcaaagccaaaataaaaaagtcgttaaaaactaaagtcagataatgcatctgttttttgaagtttttattgagtctatttttaattaaatcagtcatgtttcttcaccgtttcctgatttaaaatttgatataaacgatcaaaggaatcgcttggctttaatccataaaactgtctaatttcatttaaactaccttcagtttcaatcgtgccattatttaagacagcaaatgtttgaacagcttcttgtgcttcagccaaaacatgagttgtcattaaaaccatcttttgatcagcaacagcttctttaactaaatcaataaaattagctaccgctaagggatcaagaccagtaaatggttcatctattaccaacaagtctgcatttgctaaaaagctagttacaatcattaccttttgcttcatccctttagaaaagttaattggaagccaatccagcttattttctaaacgaaacattttgcataattcttttgctcgtgcccaagcttgatcatgatccaaatcataggtaagcattactaactctaaatgctctttcaaagttaattctggatataaaattggggtttctggaatataagcgaccatctttttaaattcagcaggattttcggttaagcttacaccattcaaaatgatcttgcccttttgcattcttaataatccaagtaagtgcttaattgttgttgatttaccagcaccatttagtccaattaaacctacagcctgtccaggttcaattgttaaatttacatttttaatgacattaatcccagagtatcctccagttaaattttcaattttaagtgccattactttttcctctctactgcaataagatacatatttatgatagcatgaacataagttaaactaaattttcttttcattaagaaaggggtcttatcatgacagaattagaaaaggattgtttattttgtaaaatcattagaggagaaattccttcttacacagtttttgaaaacgatgatgtcaaagcttttcttgatatttctcaagtaactaaaggacatactctcattattcctaagaagcacttagttaacttctttgactacagccaagaagatgctgctagatttttacaatatatccctgttattgcccaagcaattaagaagtctgatccaactattaaaggattgaatgttgaggtgaacaatggtgaaatcgctggacaagttgtaatgcattcacatattcatttaattccacgtagaagcgaaaatgatcctgtttctactcctcacgtaaacaatgcagacgaatattcagaagaagattatcaagcggttgcaaacgctatcaaaagtaatctataataccagtaattttgcctttaatgcggtacaataaaggtggttattaagttaaaaattattgaatagataagaggtatacattatgtctggatttttattaggaattcttacaggtactgttgcaggtggcttattgtcatacgctaagaatccattaagtggtaactcaattagaagtgatgttaaggattctgcagataatttcactgattccgttcaccgggttaagacaatttatgatgaactcgaagaaaagagaatggaacaacctgaagaagaaaataagactgaagaaacagatactactgaaactccaagtgaagacgaagatgttgaagtttctgaccgcccttcactcaaagataaggctcatgatttagttgatgccttctctgctgcttcattcaaagctgttgaccatgaccgtgtctttgctgcagttaagaacaaattaaatgaagcaaaagaagatcttgaagatgcaagcgatgatgttaaagatgctactgaagatgaagaaaaagtagatagcaactctggcgcaagcgaagaagaacataaggaagaaaattaatgaagttttttggaatcggattaggtttaggcagcttagcaggattaggaatctcgcttctcccaaatccacaaactggtcataaagttaaagaagatgttcggctctttttagatggcacaaaaaatgatgcttcttcattagttaccagtacgaagcaagctacacaagctgctaatgaattaatgaataatctaccacaagctgaacaaacagttaaagacatacaaaacaacttaactgattttcaaagttccattaagccagaagttgatcaaattaaagaaaatgtttctaatttaactaaagaagcaaaagacacagctgatggaattaaaaatgaactttaattttaagatttgttagtcttttttataaatatcaagaaaactcctattgtccattgggataatgggagtttttatgttatatttgaacttgtaattaagcaaaggatgtgcaaattaatttatgaataaaacatggaaaaaagcagctactgttttagcttttgcaggaattgccttaagtgctactgcttgttctggcggtaaagctgtcgttacttataagggcggtaaaattaccgaatcacaatattacgacaagatgaaagaatctcaagcaggtcaatcaactcttgccagcatgattgtttctgatgccctagaaagtcaatacggcaaagacgttactcaaaagcaagttgataaagaatacaataagtacaagaagcaatatggtagtcaatttgactcagttcttgaacaaaatggaatgaccgcttctacctttaaagataacttaaagactaatcttttaactgaggctgctttgaagcacatcaagaagattactccagctcaagaaaagaaagcttggaagaattatcaaccagaagttactgtacaacacattcttgtttcaaagaagagtacagctgaggatgtcatcaaacaattacaagatggcggcgacttcaagaaactagctaagaagtattctactgatactgctactaagaatgatgctggtaaattacctgcatttgactcaactgattctactttagattctagtttcaagactgccgcatttaaacttaagactggtgaaatcactactactccagttaagactcaatacggctaccacgtaattaaaatgattaagcaccctgccaaaggtactttcaaggaacacaagaaacaaattgataatcaaatctatcaatcaatgtccgaagatcaaaacgttatgagaagcgtaattgctactgttcttaagcgtgcggatgtttctatcaaggataaagacttaaagaacgttctttctcaatacgtttcatcagatagtctttcaaaatagaatttttacataatataaaaaaccaaggttaaaatcatcattaaccttggtttttatttactctaattttgttgctttatctaaggcatcatcatttttaggtctgtaaaatctccgattgtcttgtgacttaatggtttcagtaaattctcctggcttagtttgctgcaaagcattagtaattgcataaactgtagcatctaaatcatcaattttatgtaaaacttcagcttctagcactactggtcgatgagctgcgccatattcaggtaagccgtgatgtgacaaaactaaatgccgcaagagcattaaatcttcactatgctcatcaattttcaattcatgagctgctagcataatctgctcatcaattaaaactaagtgtccaatcaaatttccttcggccgtataagttgtggctacaggaccagatagttcaattacctttcccatatcatgtaaaatgcatcccgcatatagaagtgaccgatcaatttgaggataagtattagcaattccttccgcatcccttagcattgaaacagtatggaatgccagtccgtttctgacggcatgatggttagatttgccagctggatatgagaaaaactctttattccatttcttaagtaagtagcggacaattcgattccaggttggatttaagatctcaaaaacacgtttattaatttcttcttcaagatctttttgtttaattggagctgaatgaacaaattgacttaaatcatatccttcatttggtcccactactcgcaaatcgtaaattcttatttgcggtctatcttgatactcttctcgtcttccactcaattccacgatagttcctggactaaaagtatccgcatcctgctgactagcgttccaaagatttcctctaattgtgccacttgaatcgctaaattgtaaaactaagtattgtttaccatttttactagtacgaagacttgaatcttttagaagtaaaaccaaattcatatcttcgccatcattataatcaagcaacctttttatcattattgttccttttctattcttattggttccatctcaagattagctactaaatcttgtcgtgctgtaaaaattaaaacttgtgtcttcttagtcaactcttctaatagtttgacaatataattggttctttgtgcatcaaagtttacaaaagcatcatcaatcaaaattggcaacgcaattttatctgcaacttgttccacaaaagctaatttcaaagcaaaatataattgctcacttgtcccacgagatagatattcaacattaaattttttaccatcttctcttttaactttaagttttttatctaattggatatcaacatatcttccaccagttaaaagattgaaatatttctttgcatcttcaagcatcttaggaaaacgctcattggaggctaaatctaagcctcgcacaatccaattgctagttaataagttagctaaatattctttaacattttcactcaatgatgtttctagatcagttaatttttgtttttcagcaaaatatttatcagaatttgctaaaacatgcatctgattttcaagcttagcattttctgcatgtaaatcattaatttgctcttgcttttgagagatttgcttttctatttgatccttattttctgttaatttatttggatcttttgcaatttcttctaattgtgcgagatcagcttgcaaatcattttgcagcgcttcaattttcaacttcaattgttcttgtacttccgcttgttgctttaacttagaaaattctgcaaaatcagtaactttacttgccgcaaataaattagaaagatcaattttattcttagctaattggttctttttttcttgtaaatgtactgccacatcatttaaatgttgcttagacaaattattctgatcaattaatttttgtaacgaattcaactgatttataatatctgaaaatgtctgaacatttctttgagtaaaaggatataacccctgaacaaaagcttgaattttttcattcagagaagcttgatcttgatctagttgactaagtgtttgctttttagattcaatttgaactacttcgttccacaaactatttaaatcaatgacattaggatcaagtccatatttttcaataaattcttggtctttttggcttttcttagcattagtttgctttgtccaaacaaatagtccaagcccacctaaggcaatcattattcccaagaaacgcacaaataagttattaattgcaattgcactaaaaagtcctgcaactaataaaattaatgataaaattcctggcaaattattattttcttgcttttgactctttagagcttgataatcatcctttattttgtttcgagtctcacttgataatttgcttaatttaactgcttctggctgaaactgttcataagactttaaatctttcttagtagtttcaatttgccggtgcaaatctttactttcactttcccaatgcaaaacttcagccttatgatcaactaatgcttgaattttatctttgttagataattcgctactgttcttaatttcatcaagctgcgtctctaaatttttaatatcagctgttaaatctgaaatcttactttgaatagcccgtgctttctcataactctctttagaaaaagaaacaggttgtaattctttttttagttgctgatactgcttaaaattagttagcttttgcattaatagactaattttttggtcttctttatttaattcaactagttcagactgaatttttttcagtttttccttttcttgagttaatttttcttcaagttcacgataatcattaagttcattattggtttgagctaaaacctctttttgttcttcaatttgattaattaattgattaactatcggcttgcgtccactctttttaaaaagcttctgagcattacttgaaaactcatctcttaaatcaagtaatttgtgactttgtgatgctcctaaaaagtaaatttgttccattaattctgcctgagataatccatttacctcgcgcagcatatcctgattaaaaataaagctgtcagtataaaaactaccatctatattttggatacgatcaaaaaatacactctctggcacttcttgatcatttaaactaacttttaaaacccccttcttaggatccccttttgcatataaccgacttaaaataaaagttccatctgtatcttcaaaagttaagcttccacccattggactaacatgatccaaaggttgataatcctcaaagaaaggtgatttattagttcttaggtgaaagccaaatagaacttgctttacaaaggctacagttgtactttttccagcttcatttgcacctaaaaatatcgttaaatctttgttcaaattaaaagtcacatcatttaattttccaaagtgaataattttaatttgagttaacttcatcatctatatcctttaatttttgtcccaatttaacctgggctaattcttttacttcgtcaataaattctggtttcttcaaaatatcagcaacataatcactttttttacttaaatcactagctaacgcataaatcttatcaagctcaaaagtttcattttcagcttgatcaaatgcttctttatccgctgttctaagttgaagcttttcattattcgtcagataaacttttacaagtctagaatcaaagttcaaagaattagagagttgaagccagtactcactgtccttaactaattctagttctttttcacttaaatattgggctccttcaattgttaaaccaaataaagtttttcgtacatttttcttagtcaaagtttcaactatttgtcttgttagatctttttgtgaaatttcttgatccaaagttagggttgccatttgccaaataattggtgctgtctcaataaaatctagacttacttttttagttgtttcatctactataccaatatatacacctttactaccttgttcgttaatgtgtctaccctggagattaccactataaacaattaaggggtcttcacttaaagtctgacgtaaatgaatatgacctaaggcaaagtaattataatttaaatctttaatttcagccgttgtaaatggagcataaacattttgataatttgtagtagtttttgcacccgcatgcattaaaccaatagtaaagttatctccttttttaggaaattcactaatcttatcagtttcgatgtgattatgctgataagaaaatccaactactgtatatcgaaaatcctctttagttttagattcaaattcttctacttcttcattagagcctaaaagtttgaagtatgatgtttgtggcaataacatctcattaggattcaaataatcatgatttcctagaatcatcacaacttgaattttttgatctgtaagtcgctttatttcacgactaaaaaataattgactctgaggactagggtgagctgaatcaaatgtatcaccagcaattaatactaaatctacatttctatctagtgctgtatcaattgctttagtgaatgacttttgggtagattgtttaatatttttaaattcattagatggcaaaaaagatagtccttgaaagggactatctaagtgcgcatctgctaaatgcataaattccatactaattattttgcctttaaatcatcgtacaaatcgccaattggcttagtcatagcttgttgaacgtcgttgatcatttggaagagagcttgttccttggtaatcatgtcttttaattcgtcattattacgaacttcttcattgatcttttgatattctttttgtgcttcttcagaaagtggttgacctgaattttgagcagctaaaatttgttgttgaagcttatccattctttggtataagtctaaactttctggattattctttaaattttcaagagatttcttcaaatctttgaattgttctgtttcttgtaagtcctttgctaattgattagcgttatcgtaaatattaaccatttaaataaaaactccttttttaacgacctaaaagtcctttaagattattataccattcgttgaacttagacccagtatcattgattcctttttgtacttgttgacctaaattaccaagccagtctgaatttgcacctgtatcttttgctatctgttgggcactcttttccttaaattgtgtctgagaagtatatggaagtagccgttctaattcagatttatacaagtgagtaattccagtttctgaaataccctccatataatgttcctgatcagtcttatcaaaacctacccaagttgataaaacaacatccggagtatagccaacgatccattgatcttttgtaccaaatccataactatctggtacctcagttgaaccagtcttacctgctactctaaaacctgatggttgagctgatctcccagttcctgaagtaaatacgcctaaaagcattgatgtcatttctttagcagtattagttgaaataattctgtgactaccaggattattgttttgagcaataacatttccgctagcatcagtgattttagtaatacagtaggattgatttggtaaattaccttcgttagcaaaagcactataagctcttgccatctgcaatggtgaaacaccagttgaaagtccacctaaagctaatgccaagttttgatcactcttattaacgtgaatgccaaagttttccactgattgaacacccttgctgacaccaatcttatctaaaagccatactgctggtacatttttactttgagctagcgcttcatacattggaatcttatttgagtattgattatcaacattctttggctcatagccgttttttccaaatttttgcagtttattagaaagttcagaatcataatgatatccattctgcaaagctggtgaatagacagctagtggcttcatagtcgaacccggctgacgtttcatctgggtagcacggttatagccgcgaaagacatgttgtcctctaccaccaaccattgctcgaacagctccagtctttggatccattgcaacactagctccttgcaccttagtaccatcactggcatttggtgggaaattccagctttcttcaaaactatcttgcaaggcagtttgatagccagtgtctagcgtagtatagatcttcaatcctttgttcattacgtcttcttcttttaagccataacgatctattgcttcatcaaccacggcatcaaagaagtaagggtagcgatagccatcttcttgagaaaatgtatcatcaagagtaagcgtagtcttcttagcattatcagcttgtgtcttagaaatttttcctgtatcagccatcaatcctaaaacaacatttcgccttgcgattgcattatccatgtgatcaattggattatagtagcttggactacgaagcatacctgcaattgtagccgcttctcctaccgttacatcactagcattttttccaaagtagcgtcttgctgcatcttgaactccccaaacaccgttaccaaaataagcattattcagatacattgttaagatgtcttttttagaatagacacgattaatttcgatcgcaaaaaagagttcttctagttttctagaaaaagtctgcttttgcgtcaataatgcattcttggctaattgctgtgttaaggtagatccaccaccaacaatacctcggtggattaaactactgatggctgctcttgccatcccttttacactaaaacctggatttttataaaaagtcctgtcttctgtagcgatgacagcatcttgaatataaggcgatatctggttcagttccacaaaagatcccttttgtgagtatagggatccggccttctgatttttattatcataaattgtggttgtagtagaaagtgctgccttcatattagagatgttcgaagtttttaccttaacggtataatatgtacaaacgaacaaacaacaggacagtaatattaaaattaaccaacgccaaatttgaaaacgatggttgaagtttttaatcgctaaatgaacgcgatgccaaaactcatgattttgggaatgcataaaattaaaactcccttttcgtcaataaacctaatatgacgattttagcatatctttatttgaaaaatagtgttttaaaggttaaaaattagataaggtgaaaaaatgactatataccaatattcgctcatatatcccgactatttaatgccaatgagtgttgataagttaatgcgtaaattgcttattccaagaaaatggcggcactttttacgtagtgaaaagaaaatattagttaatggaaaatatttaccacttaattttctagtaaaacctggagataaaattgaaattcagcttgatcatattgaaagtgatcaacaaccttatcccgccagtggaaaattgcctaaagtggtctatgaagataatgatattttagtaattaataaacctgctggacaaaagacacatcccaatttaaatgaagaagatacggcattaaatgactgtgcaacttatttaggctatagtccttttattgttcacagattagatatgttgacaagtggacttttgttagtggccaaaaatcctgcggtcgtaccaattttaaacaggcaattaactgataaaacattgcatcgagaatatttagcctggatttctaactctccacaaataaaaaataccggtatcattgatcttccaattggccacgatccacatgatcaaagaaaaagaatggtgagacaagatggacaaaaagctgtgactcactatgaagtaataaaaagagataaagatcgaatactggtaaaacttacattagaaactggtcgaactcatcaaatcagagttcatttagctgctctcggtgccccaataattggtgatcccttatataattctgcttatcaagatggggaacaattacagttaacagcctttcaacttacctttagaaaaccctttagttttgaaaataaaacagtgaaattagagaaaaaataaaagagatatgccaaaacatatctcttttatttgtgcctcaaacaggagtcgaacctgcactcacttgcgtgaacagcgacctgaacgctgcgcgtctgccaattccgccattgaggcaactttttgaacacatctatcataccaaaaagttaataaagttggaaagaaaaattttaattacagaacaagataatttattttttctattattagtgcgttctagtcaacaaaacttcctgctgaaaattatgctttttatttctatttagttttctttttaaaaatactcaatccaagtgcagtaaacaagctactaatacctgccaaaactaagatagtactattgtttttacttcctgcctgtggcaagcttgcattatttctggaatttgaagctacatagccattattcatcttattatttattccagaggaaatatttttatggttacttatctccgtaaatttgttattcatgcttatttctagattcttttcaggtatctccaactttgaagctgataatgtagcggaaatatcattagttttgggttgatgattttgcttattctctagtgcatctagttttatgactgaattattattttgaactggtaatttttcaattgtcgattctgggctcttttttgaatcattaatgtagaagttagaatcgctatcttcacttactgtcttattctttttaagtgagtctaaatcataagctggtagttctatttgagcacctttatctacgctttcacctttcttaggtgagtctaaatcgtaggctggcagttccacctgagtcccttcgcctactgcttcgcctttcttaagtgagtctaaatcataagctggtagttctacttgagcacctttacctacgctttcgcctttcttaagtaaatctaaatcataagctggtaattctacttgagttccttctactactatttcacctttcttaagtgaatccaaatcataggatggtaattctacttgagttccttcgcctactgcttcacctttcttaagtgaatctgaatcataggttggcaactctacctgtgtgccgtcgcctactgtttcactcttcttaagtgagtctaaatcatgagctggtaattctagctgggtaccttcgcctactgtttcacctttcttaagtaaatctgaatcataggttggcaattccaacttagtgccgtcgcctactgattcactcttcttaagtgaatctaaatcataggatggtagttctaatttagtgccttcgcctactgcttcaccctttttaagtgagtctaagtcataagctggcaattctcgttgagtaccctcgcctactgtttcacccttcttgagtaaatctaaatcataggttggcaattccaacttagtcccttcatccaaaatttcaccatgcttactttgttcagcatttgcaaaaattgaacttctaaaatcatcagtctgcttgagttctgctgttaatatggcagcttttaagtcattaatcaaacttgattttttcccctgagctctaactgctaattcttgatcaacagtagtctgcattaaattctgcaaatcatcccaactattcaactgaatactctttttatccaacgtaatagtaattggtttaaagtcttggcgtttatcaatacgctccttgaacattgcttttttgaagattgcgtaatcattatcatattcaccattaaagatcttcgctaatgcgtatgtgtcactcagcgatttcttatcattttttgcatccttagcatacttattcgtaatataagaaataaaaccattggaccaacccttagcagctagtaattcaaaagcagtctttttaaaagtaatcccacctgaaacagaggttgagctctgaactgccgcgtaatctggtgcatacatagaaatcgtttgataactattagtgccataacttcctgcttgataaccacgactagcaataatattgttgtcaatgaaatcatcaattgtcattaacttatcagcaatttcagtactgattgggccagatactacatcggcctttttagcaggatcataactaatttgagagtacatcaattgcttatctttagccgatttacctaccattgcttgagcttcagcatagtcaagtaaataagttacatcaaaaaccccatgcatataatcttgcaagtcttttctagtttgaaaacgtgatgggcttttattcgtggttcgattattatcagcataaaaagttaatgcagtattcaagccataatttgcaaatgttcggtcccatggtgattcaagtagtcctgtagcgtatgtttctactcccgtacccggacgatgctgaaatccatctaagtaaatactattatcgaaattatgcgtcatttcgtgtgacagaattcctataccaccaaaattatttactacttgtgccacataatagcgtactgcattaccaacagcatctgccgaaagtccagccgcctcatacatcttacctaaagggccgaaaaattctgcaactgcaggaatatcggtatcacgtttatttagccatctccgaccaccttttttgctggaatcgatcgcattataactatcccagatctgaatatttgcgttgcttaagcgcttctttcccgcttcattagccatccgataccaaaaatcaaaatgatctctccatgcagtagaaagtcgggtaagttctttatgtactgcttgaactttttcttgatataccaccggatccttatggtatttcacatcaatatatggttcatatgatccaaatatcatcatccccaaagcagatacaacatacatatcatcgtttttaacatttaaaagcggtaagatatattcttgcagatctttatttgtagataagcgatgataaatattgagatttaaatcgggagcttcttttgatggaatttcaacaatatgaacgccagtatttgatctaaaccactcttcatcagatagatctggagtccactttttacgcaaatctcctaagaaagtaactaagtctgactgagtatttaataatggtgctaatttattattaaaagcagtcacagtatttgaaggagccagttcatcagttgaccagtctccaatcttagacaaccaatcgattgaatccaaattagagccaaaagcctttggatcaaacatcattactggtaagagttgcttgtctccatatgaaacgttataccaacgattaatgtaagacatccccaccataatagcacctgcattatcgctaaccctttgattagcagtatctatattatcggtgtgttcaagaagttgcggtactaaagtaggcaattgattatatacttcattaaagctatccactaaactactactagttagttgaatatgattccagtttctaagaacttgttttggatccccatcaaaggcatcatacttaacttgttttaagctatctgtaacagatttaacaagatcagcatcaactttcttttctgtttggactggttgctgatcactaatagtagcatcagagatgttattttctttattgttgatatcttgttttaaagtattcgcttcattatctacattattttgatcattttttaagtcttggttgacgtttgtagtatcgacatctgaatctgttttagtctctgtagttgtctgacttgttttgtcatcctgagaattgtcttgcgaatttatagtttctacctttgcaaggttatcatttgtattttctataacagtaatttcatttttattttctgaggtctgattttcagtcgtttgaacttgtggttcactatcagcatgaacagtcgttgttgtagcagccataaacgctaatcctacagcaacagaagttaatccaacactaagcttacgcaaagcatatcgatattgagaatgtttttgcatattaattctaggcctccaattttctataatttaagttatcttttaattataacttaagttatactgattttaaataagttaacttcacttaactgagaactaataatgccatagaaaaaataaaaaaaatgaggtatgaactcgaatatattcatacctcatttttatatactattgtttatcaattcttttgcatgcttaagaattggtaattctcgattggtaatcaattgtcccaacttagtatcaatttgttttccatatgcagcaactgcttcttcataggttaattttaaagtcaataagtgaaaatcatcaatttctgcttgcgttaagtgtttttcaccaaaagaatttattttacataaaaagtaattgttaatattatgccaatgaattaagttatagtagtcacttaccgtaccgattttacaaagaatattaacgttggcacctaatttctctttcagctctcttttaagtgctgttattaggtcttcgcctgattcaaccccaccaccagatgtttcaatgaaagtgcccgtaccaaaaatatcgtctctatgaacttttacaaaataatagttctgttgctcatctactacaatagctcgaacaatttgccgatcatgatcaatattagtcttaggccactgcgtatcttgcagttcaagttttaattcttgtatgtttattcctcctttttaatttaggctattctgataattatgacgcaagctacacggattttaaataggttaattttgcttaactaacggtgccatagaaaaatcgaaaaatattttctccaataaaatattttaattactcttttgaccttactcaaaacaaaaacctcattgaatcccggcttattacaccaagatctaataaggtttttaatctataattttcaaatatctttatactttatcactataaccttagtttaaatctaacttctgtaaaatctcatcataaactttatctgctcccatacctgttaaaagtggcaaaccgctgatcaccttatctttaacatcatcaggaactacagttgtgcttacaaaagcatcataatcatcaatattattaatttgttccgcaatatttccttttaacaattttaccttgtctaaaacacctttagattctaaaaaatcacgaattttaccttctactactgtagatgtagcaactccactaccacaaacaaccattaaagtcttcataataaatttctccttgtaaaatctaacttatagcgtattttcatttttcgctttatggaatttgttaaaccaaatcataaaacctaacgttactattccaattaagccaattccgccccaggtcattaactttccaagaccaacaattaaccaggtagtccatacaccaccatcactcataactgtgattgaactagcaccttgtaagccaaagtgtgctgctttagctgaggctgtgacaaatggagctacccaagaagcgatgtataaagtaatgataacatctactactcctccaataagcgttctaaaaatatctccaccaaatacagctgccataatagcaatcatatatggaatagtagctaagtctccaaatggaagggtactgtttcctggtaaaataactgcaattaacaaagtaattggtactaaaatcaaagctgaggaaagaactgtctcattaccagcagctaaagcactatccatccctatgtataagtttctaccagggaaacgtttcttaataaaatcatttgcaccttcagaaattggagttaagccttccattaaaagtgacaccattcgcggcattaaaaccaaaactgcagctgtaatcactcctagttgaagaacttttgctactgaatattttgctagaatcccaattacaatccctatgattaatcccataacagaaggttcaccgaaaacccccattcttttttgaactgttttaggagtaattttaatcttgttcattccaggaatacgatccattagccaatttaatggtaaggctagtaaaaatcctggatcagaagctccctgaggaaatgaaattccgggtaagccatattgtttttgaatatatggagccgacatgtctgctagcagataaataatcatgatatgcactaccatggtaaaaattccgagtgcaaaatcatttgtaattgcataaacaatcgagccggtaaaagctatatgccaataattccaaacatcaacatctaatgtcttagttaatccaattaaaagtaaaacaatatttgtaataactccaactggaatagctaaacttccaagtaccgtaccatatgctacagcagagcctgctggccaaccaatatccaatgttgaaagatgtaagccaaaattcttaaccatagcttgtgaggcaggccctaaattctttgttagcaattcaattactaaattcagtcctacaaatccaataccaacagttaagcctgctttaaaagctttacctggttttattcgtaaaattaacgcaaaaacaaataaaagtatcgggagcataacactagctccaaggttaacaaaccattgcaaacctgaactaatcgcattcataatcttatcctcttaatctaaattaataatgccatttttcttcatcactaaaataaattcatcaattgaagtaatactttgaagagcattcatggcctcttgattttgaaagagagccattaatttctgtaacatagtaagctgactatctgattgcttcaaagccagcataaaaatcatattaactggaatttcagtattgtctcccatttgatgaaaggtaattgattcttttaaacgcataaatccaatctgaggaacaataactttatctggatcacagtgcggaatggctactcccatcgtttgtgtcattaatcctgttggaaagctggattcgcgttttaatatagccggtgtgtactctttagttacagctccgactttgtataactcatcggccaattcagtcaatgcttcagttttagtcgaaggatttttgtcaaaaagtacaacttttttatcaaaaagcatctttttctcctacacttaaattaaataatttttctaattctttagaagataatgtagggtcttgaagactgctaattatcttctcatctactaaacaattaactagcgatatgattgaactatcatcagggcatgaaaatatataaatagcaatattgataccattactagtaaaatagctaacaggtttattcaattgactcacgattactatgctttcagtaatctcatgcgttactatgtggggcattattacatgttcagaaatctgcacacttcctagagcatcccgttcatggagtaagtttaataaattagtgcttagtccagatgaaagatcaagactggaaatagtttgctgaagccattgttcataattgctaatattatttagtttcactaactttattttcattcaaatacctactcaatctatttttatcctgagcattgaacatagcactggaaagaataacctgttcattattttgaggaaggacaggaatggttgaaataataaggtcaagatcagcgtattgagtagaatttttttcatactcatttttagaaatagttcctattaaatctaaatcgggaaaatttcgatgaatctttgcatatagtagttttgaagtgcctatcccactagcacacattacgatagctttttttgtaaagttagtttcttcaaagtatttagcgaaatacaaagttagaaaaccaatttcatcatcactaattttccatggtaaatatttattgctataagctttagagcttaaggtctttaatttactaaatgtttctctatattcgctttttatatcatcaagtaatttgttagcaattataatgtgattatttagacggttatacattggacgaatatgactaatcaaatcactttttaaagcttttgtttttggattattcacatctaagttaaaacctgcaatgtaataattagctagacgttttgaatctgcagaaatcttatcatcaatggcaaaatcatgattgtaacgcatagagataagatactctaataaatagtagatttcggcagtaggtatttctcggtgaacataatcagcagtattatgaattacgtcattactaactttccaaaaaatagaattatgttcttttaagtgatgatatttatttccaatgtttattttgtctttatactgaactgtttttcctcttctaaatcttttgattaaaatatataaatgagaaaaaatatttacattatagggataaggaacagtagtatgaagtgatttttgaatccattcaatttgtgtagttaaaaattgattatcatagctactcaaatcttcaaattcatttgccaaatcactgatactttccatattcattgctttactttgaataagtgcattattaattgctctacgtatattttcttcttcaccttttataactacgtaattaccttcatgggctaattttaagctatatttttttaataattcgctgattgtaagtaaatcttggcgaatcaactcggtacttacataatatgaagcataaacgtctttgacattaaccgacaatggtgcactaaaaagcaatttaatgattatttcatttcgtctttccaaaggtgactgaatcattaagtggggcttttcgtgaaaaccatcacttagctccagatacttttcataatccaaaagatatcctttccctctttcagatttaataatcggaaagtcgtaagtttggtttattttattcactgctcgataaatggttttagatgaaacaccaataatttgggccaattcttgtgacgtcataaaacgtccagactttactaaaatgctaataattttactgctatttttagacatcattcctccctccttaccttaagtttagcaattgctaatggtcacgaaagtaaaaaaatgtccatttcaacagacatttttgtcccttaattcacataatttatatttatacataaaactgagactataaaaatagcatgattactctaactttcagtaatcatgctatttttatagtctaattgtaatcagcaatccaagaattcagccttcgattttctatacttaaaagtacgcaaaagataatttcaacccctaccatactcattgacaaaatagcaggatcaaaattaagtccaatgattaatgcaaaaaatggaataataattgataaaacaaaatatacttttgatctatataaccagctaaacggcattaaatgcgcaccaaaaataattgccaataccataatcatcttttcaggaattgtaggataaatccacattgcaattaataaataaagcaattgatttagtgagaaaagaaggcctaaattggacaaaggattatctttattttgaaaatccacattaattatttttgaaattaaaaatgatagtggtaataacatccccgtacaaataaaggcaaaaagattcttagtaagaattggcaatccagaaaaataaattaccgtcattgcacaccaaataactactgaagccaaaataaaatgtagacctcttttttgcttttgagcacaatctagtctatattgatcgagttgtttcataaattgtatcctcgttattggtcttaagattttatatcattattttctaaaactgataaacacttttcaatctcttcggaagtcagtacatcactatattcttgcaacatttctgatcgaatctgctctgcgctaattccaaacttctttagcatagaaatattgtcctttagtcttttaatactttcttcttttagtgtcttgtttcttgttgcttctgctatatcatcgagcttgtcttgaaatgtcatcacttgcttcatcctctctggacttcttgaaaaatccaccatcgaatcttgcaattgttttgcatagccttttttatgactaaaaataccttgctccaaatcaaaaaattgctgcatatctggtgttacttggccttttattccttttgggttaagcataactaagtgggtaccattttgcaagaatagatctttagtctcattaaatgcaattcccttagaagtatattttttataaccatatccaaatggatcctcagtaaaaataaagataatataggtttctactagatccttataattagtacctttaggtgtataagaaacatcaagcacatcttgataatatctaatcctttttcctagttcatttggaactgtaatttgcatttcgatatcaaaaattctaccttgattatcttttgccaaaatatctgtgacgattgctttagaatttaagtattcatgcatctttttttgtgtttgaaacttgatctccacaatatttaattctggtaaagctgcttgtacaaacctcaaacaattatctttctgctccatcacccatttaaacactgggtccatagtgattcttacctgttgtagaatttctttttcattcatttgcttttctccaaattaatatttttcaatattaattacgcaaagaatcactttttttcagaaaaaaatatctaaaaattactcttacccaaacacttcggctgccgcaatcacatccagtagtgcctcatctaccttatctcttccatacgcatcaagaaagcgatcacgatacttattagttttcaaattaaaccagagtgtccaaatgccccaaaacaaatcaatatgtcgatcgccaactccgctgcaatcaacatcaatgaatcctgagaacttccaattatcaagaataatatttggtaaacaataatccccatggagtaaaactttgtcctgcaaagcatcttttcctgcttccaaaacctgatgtgcctcttctgctgatcggtaaccaaaactatcaggaaaagccgacttatcataatttcctgtttggtagtttttctcggtagttgctaaatactcactagttttctccataaccggacaatcagtgtaatctgtttcatgcagtcttcttaattcgcaagcaatggcatcacataagcgttccggatttgcgagatattctgaataaacacagtcttcgcccttcactgcccttgttaaaagccaatcataatcatttgcagtataatctaatacttctgcgctaagtccctttgaataaaagtactgcgtcatcttagcttctttttctaactttcccagtctagctctttttaaataatagccctcatctttatctacaaaatagacccttgcttcaggtgaagaggaactgttataaattggtgatccagagataaaatttctaatctcggttggtaaaacttctggaatctgagtaattaaagtttttttcatatatttaatcccatgggtaaaaatgaagtatacaaaagtaataattacaactctccataataatgatgcaaaatataatcagatgttctctttaaagttagatagtcaatattattagagaaaagcattatcatttgcttagttttgtagtcagccacaaagcaggaattatatcccggaatactcccctctgcgcgaattatatttcccttaaaatatactccgccaaagtaagctacctcttgacctttagtttgctgagaaaattggttaatcatcttagggtcttttaaaacttcgttataaacgaatttccaataatcatttggagatataaataaatttcctgctccaaagtcagaagatgtagtcactgttactgtatgccagctaacattttcgtttaatggttgcggaatttcttttttattaacttcggaaaaatcttttatctggttaagatgaagaggcttagcaaattgcttttgaatgtaattattataagttaaattactttctcgactaataattgctgctaataattcatagtccacatcctgataatcccaagtatgaagatgatcatattgcatatgatcaagcatatacgcaatttgttcttgctggtttttaagcggagcagatggacgagcattattaatcaatccacttgtatgattcattaattcccgaatcgttatatcactgcttcctggaacttgagggaaatatttagctaaagatgtattccaattgagttgctttttttgttgaagttggtaaattccagtccccgtcataattttttgtaaagaagcagttggaaacaattgattagccttcactatcttttctttattagtagtttcgttattttccactacaactggttttccatctttgccactgactaacattaccccattaatatgatgagacttcatgtagcttttaagctctttcggtgtatttcgacttcctggactcatcttatcggtcggtattacaaataaaagtaatgaaaaagcacaaagcgccatgatagtatatagaacaaatttttttagatgatgcataatattttcctctttgtgttatgccagtttttaatagagctttttcgtttattatctttctttaattgtaattcttgcatatcaagatcctcaacccttttgagacaaaaaaatatgctgcatgttttttacaaagcatacagcatttttttattttaataatcgttatttcttctccagtactgctacaacttcaacatgcagtgactggtttctgacaattgcacattggggataaacggtcatgtggcgtggttgactatgtctgtgtaatggtagttcttatatccacacaaccgttatgacccatggacttaagcattttcaacgttactcagagttaagaattttaatcagtctgtggaaacctattggtgccataaatcaagacagtgagtttgtgagaaactctaacaagatgctacctgtaccaaatataaggtttgccgtcgatatgttgaaaattatcttctcttaaatatataaatttgccatttacgatttcatacgtcttattgtgatcttcatcttttaaaagattaccactacgaactaacctcacattagggtaacaatcattgtcgtagtaatactttttgtcatcactccaaagtgtggtaccgtcatccactttataaaattcatccctcattttaaatcaccatcttattctgtctttcaattggtaaccagtacgttgtaaagtacaaagaattctcacattccttacccactgaatttggttcagggtgaaaagtattctcctcttccgctttacttatatcttgaaacttccaatgaagatcaaaaccctgcataacataattaatacattttctcccaaaaatcattgaagattttagtactggataaatcgataaatatatttcattagtaaaatgattaggatcaaaaaagcactcttgaggatacttgtgaattatactttgaagaagattccaagtattttcactgagtatcatatttaccatagttttagagctcactccctgcggaatattattgtgttcgatatcattacgcagtggcttattacaagatttaaaaagttttggaagtctgcattttctaatttttgacaaaataatagaaagcgtctctcgaaactcctaaccaggtccgaagacgatcaccactaggatcatcccagaatttcattttttcttgggcaattcgtcctgttgcttgaccaatgatatttattctggcagatgaagaagcatagtaaagtggcttgatcgcttgctttgtaaaagattcattatcaggatctgcttgaatttcttgaaaaattttttgaaattcactttgcatataatatgacccgcctttctcttattttctaaactgatataacgtgtatattatcaactaagcaataattgcctaattaaactaattttcgaataattcaattcgacgtaattgacgtttcagttgaccttgcttttctaataaagcaaatttacgagacagggtctcaggtgttgttccaaggtataaggctaagtccttcatttttaagggtaaggtaaaattatttttaccaatttcatctgcatatgtttgtaaatactttaataaccggtcttcaaccttcggcaaagccaacaagtgaatttgtttttgcatttccgaaactttaacaatatttagttccaataatcgaatacttaattctggctgtttatgcatcagcttcagtagatcctgccgttttaataaacaaatttcactgtgttccgtagcctcgacgtaattattgatatttttttgaccaaaaagccaattctcaccaatataatcacctgtatgcaagatttgcaaaacattctcatagccgtcttcatctaaggtgtactgcttagcgttaccatcagcgacaattactaaattatcatttatcgttggattaattatcactttacccttttgatagtttttatgctgaactaatttttcgatttgcatcttctcatcctgaggtaaggcattaaatagtggtactaagttaacacataaatcagccattaaattcatcgtcctttaattaaaagtcatcatcgtcgtcttcgacacacaatccttcttttagttcatgacctaagaagtcttgagttacccgaatttgctccttaatccaagccattaaattagttaaattagcagatagttctagccaactttcattgttagctaaagcaattgccttagtaatgaagagcgtttgcgtatcaaaatcttttaccaaggcaaacaattgcttatcacctgctaaatatttactactgccatcttcttctagcgtagaatattccttaaattgagctgtaattattggaatactttcaccattattaaccaataagtgattcaattggtcaaattcctgacgttcataagcaatccaaccagcagctttttcgcctaaaaaagactagcagatcctttagcaaataagttagcttggttaatctttaaagaatggattaataagttagaaataatgtgaccagtcatagcagctgcagttggctgatggtgatcaaggtcgctttgcttcaattccgcctggtatttttcttctgcattcatcagttaagctccttttccttaattccttgtacttcataacccattttttcaatagctgtcttgacgtcaacagttttagtcttatcaggatccagcgtaaattttagctttcctgcattgaataaaacttttatttggtcggttccatccaaactaccaaccgccctttcaattttgcttaagcatgaaggacaggtcatgccagataatttcatcattactttttccatgattaaattccctcttccttattaatttacatatctaatgctactttgttttgttgattataaacttgatgatcgtcaattttttgttgaaatttgattaatctcatcccgttcaagataacaattaagatactaaattcatgaataaacatcccacttgccatttcaacataacccgcaaacaaaccgatgaacaacaataagactgtcagtaaagccatcccgatattttcattcatgttcaaaattgtcttcttggataagccaagggcataagcaatcttccgcaagtcatttttaactaaaactatgtctgaaacttcaatggcaacatccgttccactaccaacggcaattgcaacattagcattagctaaggccggactatcattgatcccatcaccaataaaagcaatatggtgtcccttagctctttcttttttaacaaaagcagccttgtcttgtggcaacatttgaccatgaacttcatcgatcgacaacttcgccgcaattcgttcagcagtttcttgattgtctccagaaagcataactaactttttaactcctaattcttttaagcgggttaaagcagcattagcttctgggcgcaattgatctttaatgccaaaaacagctaattgactttggtcttcattagcaaaagcgacaattgaattacctaattgacttaaatgattaattgtcttatccaattttgcattaatacgggtattttcaacgattaagtcttggttacctaaataatatttttgattatttaaaatggcgatgattcccttacccttaacagtttccactttaattgaagctggcttttgtttatttaatttggcaattgcctgagctaagggatggttactttgatgctcaatttgagcagctaatttaataatttcatctttggacccatttaatacctcaattgcactaacttctggatgtccaacagtcaaagtgccggttttatcaaaagcaatttcatcaatccggtgagtttgatccattacttgcgaccctttaaacataatgccgcttttagcaccattaccgataccagcaactgtagatactggtacaccaataactagagcacctggacagcccagcaccatgaccgtaatagctaacttaagatctttagtaattaggcccacagcaatcgcaattacaagtacggcaggagtgtaatatttggaaaaccggttaattaacttttctgtatgtgactttgtatcttgtgcttcttcaaccatttcaataattttaccgaaagtcgtatcttcaccgactgcggtagtttcgacagtcaatgtaccgttttcaaggatagttcctgcatatacttcattaccggcttttttattaactaatttagattcaccgttaacactggcttcattaagataaccggaacctgaaataaccttgccatcgactggaacctgatcaccagttttaactaaaatcttctccccaggatcaatgaaatcgacgtcttctttctcagttgagccatcatcttgaacaactaacgcagtctgtggtgccattttggttaaatcagcaacggctgaccgggttttctttagggttaattcttccagtacatctcctaacatgaatagccaagtaacaatggctgcttcattaaatttaccaataatgaaggcaccgattaccgccagcgatactaaaacatcaatagaaattaatttaacccttaaagatgaaatagccgtcaaagcaattggaagtactccgacaatccccacgataagcatcaaagcctggtatggtaaattcatgtgcaatagccatttagatccttcagcaagcaacagcagaatagtattaacaagcaaaagctgctttttgtacctcataaaaaattgttgtaacttaatcatttttcccctctccctttcttgacactacacattataggtaaaaaacaatttaggtgacttgactattatcaagatactagtgtctttttatatttatcttttaagcaaaaaatcacagttttatcgtgtaaatttcgtttaataaaagagagaatatacaaaaaagactagaaaccatgcaaaaggcatggactctggctttcaaatttcagttctataaaaattaatgtgccaatttaatctctccagcagcaattggcaaagttgtatgtgcatcataactcataacattaccggcaacgctagatggcaatttaagatccgctggtacgccgtgaacataaactactcgtttgtctaattgaagatcgtcactaccaaatgcttgcttaaattttacttgtaaatcttttaatgggacatccttatcatattcataatgaccgtatttatctgcaaccgggtagccatcatggggaatgttcatttcttgtggtgcatcatcaaaatgaaccatcgttgtcccagatactacctctgtttcaggtaaatcaataaagccatcatgattcacatcctgcattagcgtcggaacatgagcttgtttcccatctggaaatccatggaaatgttcccaatgttcaatattggcaggcgtatcaaatatttccacatgaatatgaaggctattaccattttcactgaatgttgctattccatgcgcctgtgcttcaattttatccgcatttattggtttaatttttgcaatatagtcaactattactgtttctctcatcaacttaaccaactcaactccccaaaacggacacttatctacacaacctaaaaatccagcacgttgtccactcgaccctctagctcaacaagcaaaaagtgtactaattccaatcaccaaaagaggaattagtacacttccgattacctaaaaatgccgttacgccggcatttataacctatttttctgtacgttcaaggactgctacagcttcaacatgaggagtttgcgggaacatatcaactggatcaatttcatcaaagtcataaccttgttccttgaagagttgcaagtcacgcaccatggttgctggattacatgaaatataaacaatcttcttgggatttgtttccacagcagcgtcaataaattcaggagttaaaccttttcttggtgggtcaacaaagatgacgtcagtctttaagccttctttagcccagcgcggcattacttcttctgctttacctacaacatattctgcattagtgatgccgtttaatttagcatttgcattagcatcttcaacagcgggctcaatgacttccatcccccgcactgccttaacgtgcttagccacactaagcccaatggtaccaataccagaataagcatcgattacgacatcatccggcttaagatcagctttttgaatagctaaatcatacaaacgtggagtttgaagagaattaatttgaaagaaactttgtggagaaattttgaaactaacatccccaattttatcggtaatttgtggttctccccaaagcaagtaatcttttttacctaagatcacattcgtctttttaggattatggttcaaaactacgctagttacgcccttgatctcactaatttctttagtaacttcttttaattgtggaaaatctttatgtaagcatactaaaatcaccataatttcgcccgttgctttagagcggcgaacttcaagatagcgaacttctcccttattatgaatctcatcatatgcaggaacatgattctttctcaaaatgtcgcgtaccttaattaaaactcggtcaatctctggatccgtagtaaagaagctagttaacggcaccaagtcatgagaatgttttctaaaaaatccaatatcaagcttgccattaacttcacgtactggcacttgtgccttattccgataacctgtttcttctggactaggcatcgtttgacctactttaacattatctaaatctgctttatgtagtaaattaacaacttgattacgtttaaattcaagctgtttatcatatttaatatgagcaagagatgctagccccgtttgaacccattggcgaagtttcacgttaatccggtctggactctcttttttaattttttcaattttagcaaaagcaaaatttttctttacttttaaaagtttggcagaaacaatctcacctggaagagcgttatttacaaaaaccgtcattccatctagatgagcaacccccattgcttcataagacaagtctgtaatttctaagtcaactatttgatttttttgcataattcaatcctcaatatttagatccttgttactattttactaaaaaatattattgctttttaaaagagtacgcactaaaaatacttaagataattcctaaaattaaaccgcaaattactaagctccatgatccaaagacaaagtcgccttttatccacagattatttaagaccatcccccagtcaaatggccaccacatgctccaagttgtatgacttaaaaacattgctaaaatagatcctaaaaaaccaattcctaatgcaaaatatagattagtaattcgtacgagccaagaataaaatggcaccagccataaagatgctaataaaactccaattattgaacaaatcattaagcttatttcttcggtactcgaaaaaataaaacgaacgcagatcatcaaaactataaaaatcacgctcatgatacatgcttgaataattccatggagaatcctcccaatttcatagctcaataagtcttgtggagatgtcagtatttctctaaattttgtagcttgcttttgataataagtactaagaccaacaagtagtccaattgacatatttaaccagaagtaactccattggcccatcattaattgaactagatattggttatcccagaaaacagcagtcatcatcaaaacagcaatcactggtagtagccatactaataagcgaactacactatgttttgtttttaaaaattcaacttttaaaatattagtcatgctttatgcctgccttttctaaagttgagataaataattcttctaaatctgtttctggttcatagtcttcttctaggagcaattttccatcacctaaaatagcaattcgatctgcaaccttttgaatttcagaaagcatgtggctagctataattattgtttttccttgttttttctctagcatcaaaagctcacgcaactcatgaataccaaaagtatcaagaccatttgttggttcatccaaaataactaaatcaggatttcccataaaagccaaggcaattcctaagcgctgtctcatccctgtagaaaagcctttgactttttcatgattatgatcaccaaaacctaatgtatttaatatttgttcctgatttttattttcaacacggtgaagttttagttttaatttgatgttttcttcaaccgttaagttatcaaacaatccaggctcttcaattaaggagccaattacttttaaatcttctctcttccaatttttatctttgaaagtaactactccttcagttggcttttcaattccactaattatttttagtaatgttgattttcctgctccatttggtcccataatacagtagattttgccagtcggaacattaaggttaatttgatctagaacacgcttatgtttaaaattttttcctaattctttggtggttaaaatatcattcatcttaatccctcaatttaaatttttagtttttctatacctatctattttaccgctcagaccacataattcgaaatcttattatttttattaataaattcattgacatctttttttaagcttgctatcataattgcaataattatcgtcacagtagtgcttatgttaagcgtcagagagctggtggtgaagtgcgaaccagtcaggcataagttacgaattacaacgattcatctttattcggccacaatcagtgccgttaccacctgattagagtgctgcaatctgcagtaaataggtggtaccacggtaatgcgtcctgttgattaatttcaacaggacttttttattggaggatttttatgaaaaagaaagtttcttttccagaagcgatcattatcttactcttgcttctacttattttaggcatttcagttattaagtttggactgatgccggaagttcccgttctatttacagtatgtttattattattttggcttagaattcgtggaaatgattggtcttcaattcaagacggaatcaaagaaggaattggtgtagctattattccaatttttatttttatcttaattggggccttaatcgggctatggattaaaggaagtattatcccatcaatcatggtactgggcttccacctaattagtggtcaattttttgttccatctgtctttattgtctgttcaattgttggtcttgctatcggaagtggctttacaacaatttcaactgtcggtattgcactctttggaattggagctagtatgaatgctaatccagctcttgttgctggtgcaattatttcgggagcagtttttggagataaaatgtcccctttatctgactcaactaatctttcttctgcagttgcagaaagtgaattatttgcccacataaagaacatgatgtggtccaccattcctgcctctgttgtttctttaatccttttttggattctaggaaacagtggttcaatcgatgcttcaaaaattaatcacaccgtttctatcttagagcataactttaatattacttggtgggcaatcgtaccaatcttattgatgttaatctgtgcatggcgcaagattcccgcaattcctaccttatttttaaacattactgttacagtcattatgatttttattcaaaatccgcaccaatccattactgacttaactaacttaattatgaatggttttgtagcaaaaactagtgattcatctgttaatgcccttttaaccagaggtggtatctccagcatgatggatactgttggtttaattattgccaccttatctcttggtggactcctcatgaaattcaatattgttcaaactgctatggaaccgctagttgaacatctcaaaaaaccgggccgtttagtcatcactactattctttcaggcatttgtatcaacttatttgttggtgaacaatacctatcagtaattttgcctggtcgtgcctttaaacaagcttacgaccgaattgggcttcacccacttgccttaagtcgagttcttgaagatggaggaagtgtaattaactacttaattccatggggagtagctggttcttttgccgcttctactctcggtgttccagttttagccttcattccctttaccttctttagtttactttccccacttttctcaattctttccggggttacggggattggtttaaaatggcaaaagaatcctaaaaattaattcatctcattaaatccgtactatatgcgcctacacagcaaaatagtacggattttttattgacgaatttttaattacattgtaaattattagtaattaaaaaaatattaaagaggaggagtttgatgacaacaaatcattttctagtactacaaactgattttggcttaaaagatggggctgttagtgccatgcacggagtagcacatatggttgcgccacatgttattgtgtccgacttaactcatgagattccgccttatgatatttgggctgcttcgtatcgtctatatcaaactattaagtactggccaaaaggaacgacttttgtttcagttgttgatccaggagtgggatctaaccgaaaaagtattgccgctaaaacccaaagtggccaatttatcattacaccagacaatggttccttaactcatgttgcaacttatatggggctagaagaagtacgagagattgatgaacaaaagaatcgtcttccatattcttcagaaagtaacacttttcatggccgtgacatctatgcttacaatggggctttactcgctgagggagaaaaatcttttgaagatttaggcgaaacattagatccaacttcgattgttaaactaccacttactgaggctagtctagaaaacgatcatctacgcggatcaattgatgttttagatattcgctttggttctttatggactaatattccttatgatttaattaaaaaggcgaatattcaacgcggtgataaacttactgttactattacttatcaagaccaagtttattatcatgatacaataccttttgtccggtcttttgccgatgcaccaatcagtgatcctttaatctatattaattcactagttaatgtcggcatcgccttaaaccaagcttcatttgcggatacgtataatattggtacaggaaatgattggaaaattgatttaataaaagaataatttatttacgggggaaaattatgaataatcaaaaaggcttatcagtaaaaagtgtggttgcaattggtattggagctgccatttatgttattttagctcgttttacatcaattccaactggtattccaaacactaacattgaaatcgtatatccatttttagcattacttgcaaccatttatggaccagttgttggtttttccgtgggattcattggtcatgccctaagtgatttcttaatgtatggacaaacttggtggagctgggtacttgcaactgctgtcctaggtttaatcattggactttatggcatgcgtcttgatttagagaacggtgttttcactactaaacaaatgattggttttaacattgtccaaattattgctaacgttgtttcttggttaatcatcgctccagttggagatattttgatttacagtgaacctcaaaacaaagttttcttacaaggagcaactgcaaccatcactaactcaatctctatccttattctaggaactatcttgcttaaagcttatgcagcgactaaagttaaaaaaggtagtttacgtagagattaattatgaaaggttactcaattaatgacagaacctattattgaatttaaagatttttcatttaaatataatagccaagcagaacctactcttaaaaatattaatttgaagattaataaaggagaaaaaattcttttggctggaccttcaggcagcggcaaatccacaattggtcgctgccttaatggtcttattccaaatatcgatcaaggtgaagttaaaggaaaatgtttagtgaatggaaaagatattactagcacaagtctttttgatttttcattcactacttcaactatcttacaagatgctgatagtcaattcattggcctaacagttggtgaagatatcgcttttgctttagaaaatgactgtcaacctaaagataaaatgcaccaaactgtaaaccagtgggctaatgagttaaaaatcaaagaactacttactcaatctccacaaagtctttctggaggtcaaaaacaaattgttgccttagctggagttttagtcgacgagtcacctattttattattcgatgagccacttgctaatctagatcctgcttctgggcttaaaacgatggcaattatcgataaaattcaaaaggaacttaatgcgacagttataattattgaacatcgcgtagaagaagtcctcagtcaactaattgacagaattattttagtaaatgaaggtacgattgttgctgatcagcctactaatcaattgctccactcaaacaccttagaaaaaattggcgttagagagcccctatatctaaaggctcttacagccgctgatgtaaatctaagttctattaaagaagtagaccagatatcaactctccctgtttctgaaaaaatcagcgataaattagcagcttggactaaacaagctaaaatcaccaaaaaagaagtagataatttaccattattaaaattagatcacgttggtcatcaatacagcaagaatcagccctatcccttaaaagatgtttctactactattaatcagggcgactttatttcaatagttggacaaaatggtgcaggtaaaactaccctttgccgaactatttgtggttttatttctaacgaaggaaaaatcactcttaaggaccagaatttaagtgacttatcaattaaagagagagccgaaaaaattggctacgtaatgcaagatcctaatcaaatgatttctcaaaaaatgatctttgatgaaattgctctaggtttacgtttacgcaatgttgatgaagaaacaattaagcaaaaagttgaccaaacgttgaaaatttgtggactttatccctttagacattggccaatttccgcattaagttttggacagaaaaagcgtgtcacaattgctgcaattttggtcttagaaccagagattattattttagatgagccaactgctggtcaagactggaagacctatacggaaattatgagctttttaaagcatctaaacactatggggaaaacaatcattattatcacgcatgatatgcacttgatgcttgagtacactagtcgatctctagcatttgctaagggaaaattaattgcagatactaccccaattgaattattaaccaatcaagctttaattaaagaagcctcattaaagcgcactagtctttacgacctggcaaaacattataacttacctgatccaaataaatttgtgcaggcttatattaattttgaacaacaaaactggaaggatgaagattatgaatgatagtaaaattttgggctaccagccaggtaatagttttattcatgctctcaatgctactacaaaaatgatctttttaatcctggtatccattgcttgtatggttacctatgatactcgcttcttgattgctatctgtatcctatccttaattttgttaaaaattgctggcatcaaatggaagcaagtttcttttattgttaaattcattattgtttttgccattattaatatcatcgctgtttttatttttcagccaacttatggtgagacactctaccattcaaaaacggttctaatcaatgcaggatacttcactttaactgcacaggaactattttatttatttaacgtaattttgaagtatatctgttctatccccttggttctactctttttattaactactaaccctagtcaatttgcagctagtctaaataaaattggggtcagttataaagttgcctatgcggtttctctagccttacgctatatacctaatattcaggaaagttactggtcaatttctgcagctcaacaagcaagaggaaatgaactttctaaaaaagcttctcttggaaaaagaattcatggaactttaaatattgttactccacttattttttcaagtcttgatcgtattgatacaattagcaccgcaatgcaacttagacgctttggttctaaaaagaaacgtacttggtatgttgcagaaaatttcaacttagctgattatctagttactactttggcttttattcttgtactagttgtaattttgctctttaaagtcaactcaggacgtttctataatccttttgtataaaagtttcttttactgccaagataagttaaaatatactaataaaaagaaagagggagagctttatgaataacttttcacaagaaccagaacgccgtacaattgtcgacgtaactggtttaaatagattcttaagcagaatgtacggcatgatgacaattgctgttttagtatctgccttaagtgcttacttaacaatgactgtctttagaacacaagttatgaccttatttgctagcaatccagcaatgacttggattttattgctagttccacttgctttaacttttggaattagttttagagcaacgagaaatccggtagctagctttgtaatgctaatgatcatggcaattgtttatggagttgaattttcattaattgctggtgcttatactggccacagcattgcttctgcattcgtagcttcttctactgtattcattacaatggctgtaattggtaccacaactaaaaagaacttaaataatttaggatcatatgcttctgcagctttaattggattaattgttgcaatgctaatcaacatgttcttaagaaatccaatggtttcttacattttctcatttattgcagttattatctttactattttaactgcttgggatgcacaaagaatgaagcaaatctacgaaaactacagtggccaagtttctgttgacggcttagcagttgcgggtgctttggcactttacttagatttcgttaacttattcttacaattcttacagatctttggatttagcgatagaaattaatattctacataaaaagctactaaatcttggtgttaaaaccttgatttagtagcttttttggtttgcattatttattactcaattttgccaataatttcattctcataagtttgatcatgaactgcttcaatattttcatcaaaattgaattctgctgtatgcttatttttaagcttaactttataagtagctcccatcttgaaccattcatattctgagtcaatatgacctaaatcgatcaattgattatctaaatcttggagatcatccacgattaccttagctgttggtccaagcattaatagaactaatctatcttctgcattttctcgaatcatttgttctattttattaactttttggtatgcatttcttgatggtgcaagaattcttttaaccgacttggtgttatcaaataagtcgttacccactcctgaacgtgttaacgctccttcaacaattaagatatctttttctttccaaatttgcttaagtttattaaaccaaccagcacttttagccttatcaattcgatcaatatatgggcgagaaataaaagtattactatagatattttctgttttttctacttcgcttagaagatactgattgttaaaaaagaaattagtttcataaaaatcttttgtatattgaccataatcctctaaactttcaaatacatctggaagggctacatcgtatttattattaccgcccgcaaaaagtatctgttttaattttttcgatagatccttattatatgcttgataagtaataccttttccattaatcaaactcaattctccatccccaaaacgaataatggattttttctcattaataagtcgatctagcgattcatccattcctctgacatgtatattaaaaagctgaggaactacgtggtcagtaggacgttttactaacttttggattacctctgccatttcatcaatttgatcatcttcaaagacttgataggcatcataatttctactttcagatcttgaagaattaaaggccaaaataggaacttgccgacgcttaatccgattaagtaccattttatttttatcaccataattaatatcaaggtaaacggtgcacttattaataagctcaatttgttttttagccgtagcacttgggtatatagttacattatcatattgagataaatgacttaataaaaaggcaactggagtaaatgctgcaatactaaagtgaatattaggtaatttttttactagctcttctaaattttgaacttcagcgacattcgtaaatatataggcctctccgtcaaaggtcttatcataattgtcatttaattcaaagtttctaaaaataatttttgaccattctaaattgtggtactcccaccatttctctcttagttcagttgtatcagtgatgttaaatggcttatctcgctcagtaaaatgaataatagcaggctcttttatatgatcaaagaatgcataaaaactgtctttatcattccaataactttttctctcatagccaatttgataattatattttggatctaactttccataattctgcgcaaatcctgcattcatcataacctgggtgttatttaaattatatttcttccctaaatccaataattggtttccgatattgttgttataccaaaatctattattaattaataagactcctgaattaaattgatcaggattaaagtagtccactacagtatacaaaggtctattttcaatattagtttcaaaaagctgatctaaattttggtccacaattacatcactatctaaataaagaactttatcttctttaattaattctggaatcaaaaatttgccatataccatcttagaaattcgattttcaggatttggcatatctttaaaacgactaagatcaatttttaaatcgataacttctgagtttagacttttcaaatattgattaatattcataaaccactcatgtggaatatcaggattaataatataagtttttacatcttgattatgcgcataaatggactttaaagtggtctctgctttatcaatccagccatagtctacacttaaggcaattgtcttcattattcaatcttcccaataatttcattttcataagctttatcatgaacagcattaatattttcatcaaaattaaactctgcagtatgcttattttcaagcttaactttatgagtagctcccatcttgaaccattcatattctgaatcaatatgacctaaatcaatgatttgattctctaaatcttgcaaatcatccacaactactttggctgttggcccgagcatcaacaaaatcaacctatcttctgcattttctcgaatcatttgttctatttgatcaattttttggtatgcattctttgatggagcaagaattcttttaattgatttagtattagtgaataaatcatttcctactcctgaacgcgttagtgctccctctacgattagcagatcacgaccactccaaagttgtttcaatttattaaagtaaacagcacttttacttttatcaactagatcaatgtatggtcttgaaataaaagttgaaccataccaattaccagtttgtccaatttcttttaagaaactttcattatttggaaagaaagatttttcgtagaatgattgagtaaaatcttgataacgctctggtttggtaaacacatcaggtaaacaaaccaatgtattattaaattggccccgcaaaataatatcttttagtcgattggcaagttctgaatcatatgtttgatagggaattgaggctcctctaattaaatcaaattcgccatccccaaagcgaatcacagatttattatcttgcaaaatcaagtttaaggattcatccatatcttttactctaatattatattttggagcattagtttttactgtctctttaatcgcttctgccatttcatcaatttgattatcacgaaagacttgataattatcataatccaaattttgagacttagtctgatcaaaagaaaagataggtatccttctcttcataattctttcaattatttcatcagctttaggaccataattaatatccaaataaatatctgcttcatttatttctctatccaaaggttttcctataatagtcgggaaaagtctcacattatcatattgtgttaatttcaataaaagaaaagccataggcgtatacgcagcaatattgaatcttatatttggcaatttttgaatcaactgttcaatattctgtacgtccgccatacgagtaagcaaaaatgcctctccatcaaaagatagatctttaattttactcttatcaaaactactatatttagaaataatttctgaccattctagtcttctataatgccaccatttgtttcgtaaactaactgttgatactaagttaaatggcttgtcttcagtaataaagtggattatttttggttttttaactttatcaagaaattgtgtagttttttgcagatttccccaaaaagctgctttttcaaaaccaatttggtaattataagataaatctagttcttcaattttatctttaaatacttcattaatgacagtctgatcaccatttcgaagattaggcccttttgctttttctaaaaggctagaaactatgttactttccttccactttttattattaatcaataacattcccgaattaaattctgcaggaacttgatagtcacgcacaccacaaacccatttattttctaaatcaatattaaataattcatctaaattggcattcacaactgtatcacaatctaaatatagtactttatcttctttaattaattcaggaattagtattctcgcaaaagcaatatttttaattcctttaaaagaagaattaacgtcatttaaatatgcctgatcaatttttttatctacaatttgtgaccctatttgactgagatattgattcaaattaatgaaccattcgtgtggaatatcaggattgataacatagatttttactttctgattatgataaataattgatttaactgttgtttcaattttatctaagaatccataatcaccatttaacactatcgttttcaaacttatcactcatttctattaatatttaaacatctaactttcacgaatcgcataatatattatctactaaaaatacattatataacacttatattctatttatctataagtatctaatacacttacaaattgttttgagattgtagataaacaaattaaacgtactacgctatagttaagtgcaaaatcaaagataacactatataaaataaaaggaatcaaatagataacttatacctacttgattcctcattaagagcttttatttcttatttattttcataattatttctttttggtactgaggattatcttcttcattcagatttttatccacagattctgccatatgtttatttttaccaatcgatactacatatttagcatccatcttaaaccattcatattttgtatcaatatgcccaatgtcaaggatctgattatctaaatcttgtaaatcattgacaattactttggctgtaggtcctaacattaataaaatcaacttattctgagcattatttctaatcgcttcttcaatttcatgtacttcatcgtaagcatcttcagcaggacaaattatacgctgaattgatcttacattttcaaaaagatcattgcctactcctgaacgagtatattccccttccacaatcaaaatatccttattctgccaaattttcctaagtttatggaaataatgttgacttttactcttatccttgaaactcatatacattctagacataaatgtcgagccatatgaatacttcgtcttttcaatttctttaaaaaagtcactaaatctcggtaacactcctacagcataataaccacgcatttcattatatctgtctaaattagtaaagatatccggtaaacaagttaatacccttggattatggttatttagaatactatcttttaatatcttcgctaactctggattaaaatgttgataaataatgtcttcaccatatatcaagtctagttcaccatctccaattcgcaccacagatttcttattttcaattatttcatctaaagtttcatcaattgatttaactgaaatatcaaaaatatcatcaaaagacttcttagaactattagctggtaatttattaacttgttttatcatctcatccatactgtcagctacgtaataattattactctgttcatgatattgagtatccctaaaagcaaaagtaggaatatccagcaatttcaatacagtttcgaaatggacattcttattgccatagccaatatcaaaacaaagatctgttttttcgataattgactttaattggtaatttaaaatttgaggataaagggttgcattcccattttgcgttaaaatgtctaaacctgtatataatgcccgtcccgaaacaatattaaaatgaatatttggtaagcgcctgattaagttcttgtgcgccatgattttctgcgtaattcaaaaaaataatagcttctttatcaaatttattttcaagtctgttagaagttagatgattgattacttccgaccattcactactatgataattccaccactttttacttaagtttttagatgaactttctctaattagcctactatcactagcatattaaataattgcaggcctctcaacagtgtctacataatacagatatgaatttgttaattcaaaattaggatctccaaatccaatttgataattgtaaatttcaggcaactttccaatattgataccaaacccatcattaatcatagcttgctcataaactagaccataatttttgcttagttctaaaaattgattaccaatattgttattgcgccagtagatattatttataagcataacacccatattaaacttatcgggatgtacaaaatcaattattgcatacaaaggcttatcttctacatcaattgcaaatagatcatctaaattttgatcaataattgtattgttacctaagtaaagcacttcatcttcatctactagctcaggaattaaaaatttgccatataaaagcaaaaacactgatatatcaacgtttatttaacgatgattatcagtgttttcttcattttaaatacctattttttattattttttctggatcttaaccctaataatgctcccaagctagctgcaattattcctaacaaactggaattatttttagtacccgtttgtggaagcttctggttacgaggccgctttgccattctattagtcttatttactttaattattccaattgattcggaatttcttctatttgaagatagacgcttttcgctagcaataggtgtaactgagtttgcttgtcctgtttcacttcttagtgaatttgcaggaatttcagaaggtatcaaactttgagaagctgaaacattcgaggtacttaagctttcactagtatttgttgaacgcatagatttagaagtaatagaagtagagaaactagtggattcagagactctttcgctcatgcttaccgagttagataagctctcaatcatcgatactgagttgttcatgctttcactcattgagaccgaattacttaaactttcgctcatcgatactgagttgcttaagctttcactcatgcttactgagttgctcatactctcactcattgagaccgagttgctcatgctttcgctcattgatactgaattgcttaagctttcactcatgcttactgagttagataagctctcgctcatcgatactgagttgctcagactttcactcattgacactgagttgcttaggctttcgctcattgacactgagttactcaagctttcactcatcgatactgagttgcttaggctttcactcatgcttactgagttacttaagctttcgctcattgatactgagttactcatgctttcactcattgacactgagttgcttaagctttcgctcatcgatactgagttgctcagactttcactcattgacactgagttgcttaagctttcgctcattgacactgagttactcatgctttcactcatcgatactgagttgctcaagctctcactcattgacactgagttgcttagactttcactcattgacactgagttgcttaggctctcactcatgcttactgagttagataagctctcgctcatcgatactgagttgctcagactttcactcattgacactgagttgcttaggctctcactcatgcttactgagttacttaagctttcgctcattgatacggagttgcttaggctttcgctcattgatactgagttactcatgctttcactcattgacactgagttgcttaagctttcgctcatacttactgagttacttaagctttcactcatcgacactgagttgcttagactttcgctcatacttactgagttacttaagctttcactcatcgacactgagttgcttagactttcactcatgcttactgagttactcaaactctcgctcattgatactgagttacttaagctttcgctcattgatactgagttgcttaggctttcactcatgcttactgagttacttaagctttcgctcattgatacggagttgcttaggctttcgctcattgatactgagttactcatgctttcactcattgacactgagttgcttaaactttcactcatgcttactgagttacttaagctttcactcattgatactgagttactcatgctttcactcatgcttactgagttagacaagctctcactcattgatactgagttgcttaagctttcactcatgcttactgagttactcaaactctcgctcattgatactgagttgcttaagctttcactcatgcttactgagttactcaaactctcgctcattgatactgagttactcatgctttcgctcattgatactgagttgcttaggctttcgctcatgcttactgagttactcatgctttcgctcatgcttactgagttactcatgctttcactcatgcttactgagttgcttaagctttcactcattgatacggagttgcttaggctttcactcatgcttactgagttactcaagctctcactcattgatactgagttactcaaactttcgctcatgcttactgagttacttaagctttcgctcattgatacggagttgcttaggctttcactcatgcttactgagttacttaaactttcgctcatagatactgagttgcttaagctttcgctcatgcatactgagttactcaagctttcgctcattgatactgagttgcttaagctttcgctcatncatactgagttgcttaagctttcgctcattnanactgagttgctnaagctttcgctcatgcntactgagttnctnangctttcactcattgacactgagttgcttaagctttcgctcacgcatactgagttactcaagctttcactcatgcatactgaagtgcataaagcttccactcattgacacggagcggcttaagctttcactcaggcatactgagtaaccaaagcttctcagcatgtgatactgagtggacgaaaacaatcgctcacgctaactgagtaacataagctttcgctcattgaaacggagttgcttaggctttcactcaggcttactgagttacttaaactttcgctcattgacactgagatgcttaagctttcactcatcgacactgagttgctcatactctcgctcattgataccgagttgcttaaactttcactcatgcttactgagttgctcatgcttccactcatcgatactgagttacttatgctctcgctcattgatactgagttgcttagactttcactcatcgacactgagttacttatgctttcgctcattgacactgagctactcaaactttcgctcattgataccgagttgcttaaactttcactcatgcttactgagttacttaaactctcactcattgagacagagtcgcttaagctttcgctcattgacactgagttgcttagactttcactcatcgataccgagttgctcatactctcgctcattgataccgagttgcttaagctctcactcatgtttactgagttactcaaactttcgctcatacttactgagttgctcatgctttcactcattgatactgagttacttatgctctcgctcattgatactgagttactcagtctctcactcattgagaccgagttacttatgctttcgctcattgatactgagttgcttagactttcactcattgacactgagttgcttaagctttcactcatgcttactgagttacttatgctttcactcatgcttactgagttactcaaactctcgctcattgatactgagttagataagctctcgctcatcgatactgagttgcttaagctttcactcatgcttactgagttagataagctttcgctcattgacactgagttgcttaagctctcactcattgacactgagttagataagctttcactcatcgatactgagttactcatgctttcgctcattgatactgagttacttaagctttcactcatgcttactgagttagataagctttcactcattgatactgagttacttaagctttcactcatgcttactgagttgcttaaactttcgctcatcgatactgagttgcttaggctttcactcatgcttactgagttgcttaagctttcactcatcgatacggagttacttaggctttcactcatgcttactgagttgctcaaactctcgctcattgatactgagttgcttagactttcactcatgcttactgagttacttgagctttcgctcattgatactgagttagataagctctcgctcatcgatactgagttacttaggctttcactcattgacaatgagttgcttaagctttcactcatcgatacggagttgcttaagctttcactcatgcttactaagttgctcaaactctcgctcattgatactgagttgcttaggctttcgctcatcgatactgagttactcatgctttcgctcattgacactgagttactcatgctttcactcatcgatacggagttgcttaagctttcgctcatcgatactgagttactcaaactttcactcattgacactgagttgcttaagcttcgctcancgatactgagttgctcagactttcactcattgacactgagttgcttaagctttcgctcattgacactgagttactcaagctttcactcatcgatactgagttgctcaagctctcactcattgacactgagttgcttagactttcactcattgacactgagttgcttaggctctcactcatgcttactgagttagataagctctcgctcatcgatactgagttgctcaagctctcactcattgacactgagttactcaagctttcactcatcgatactgagttgctcaagctttcactcatcgacactgagttgcttagactttcactcatgcttactgagttactcaaactctcgctcattgatactgagttacttaagctttcgctcattgatactgagttgcttaggctttcactcatgcttactgagttacttaagctttcgctcattgatactgagttgcttaggctttcgctcattgatactgagttgcttaggctttcgctcatgcttactgagttactcatgctttcactcattgacactgagttgcttaagctttcactcatacttactgagttacttaagctttcgctcatgcttactgagttactcatgctttcactcatgcttactgagttgcttaggctttcactcatgcttactgagttactcaagctctcactcattgatactgagttactcaaactttcgctcatgcttactgagttacttaagctttcgctcattgatactgagttgcttaggctttcactcatgcttactgagttgctcaaactctcgctcattgatactgagttgcttagactttcactcatgcttactgagttacttgagctttcgctcattgatactgagttagataagctctcgctcatcgatactgcgttgcttaggctgttgctcatgctttcgctatgagatattactatactctcactttgtgaagcactaatacttgccgtatctattttacgtaagtaaacagtaaatttattaggaccatctcctaatgatccatatacatatttacttaagtcacttatagatacaccatctggtggagttaatacttgaccagtttggttatcgacaactttctcaagaatatatccttcactttctaacccctctaatgtcgcagtagcatctgaaaaaataattgttccttcagcaggtccttggaaattattcgtagcttgcgtaagtgtaattggatttgaaggattagtatcattaataaattcaagtgtagcagttcttgtattagtagaatcacttgagttggtaacatctccattaacaccataggcaataccagctttccaagtattccaatcgatagtatttggtaaaggaactgtatctcctgtaacattatttgtaatagtcataaccgggtgtgctgtattttgcaatgctgcttgtaaggctgtattacttgtagctgcacccatattaggagtattttcatagttattcttatctacagtaggtgatttatcaagatcttcctgatatgacttgatatcatctggcattgtaaaaccatttgcacttactgttaaaggaataatcaatccctttaatctaattgaagagtcagcaattttaacatgataaaccatttcaatttcaccattagctgtagtggtttcttcatgtgttactgtaactggcgaagtcatttgactaactttatttatttcattcttcaaataaacatttgtaggagaacttccagcaacttcattgcttaattcattatttacataccatgcatagatgctcttaatccggtcttccatctggctgtccgtaagccaagtataagtaaattctttactattccctacagtaatcgcaatatcaaaattagagcccgtattagcttcagaagtagctgctccactagtagcaatcttaaagcctatagcattggcccaattagtatttatggagacactattatttggtccccataccctattgttattataaaaaatacctgctgtagtagtattgttacaatcaagatattgcttgtcatagacatattgcccttgaatgtgaaggccactagcgtaatgttgtccatttattgtcacatcattggtaggagtataagcaaataaagttccatttttagattcatcatcagtatattgataaacataaacttttcctaaattagtggtattatcactaccttgattaatactaatggatggttgttgggactgtggatttccccatcttaatatcggattaagagttaacttattattaccactggtataagctgcagcttctgaattaaaaactattctatagtacgtacccatattataagcagtagctatttgaactccattaggagtcattaaggggagattagctgctaatttactatcataattttcaatattcccattactatcgggtagtcccaaatggacgtcaatatattgaccatcttgcaaagtttgttttggagtaattgaaaaggcgagctgttcatacccagcatcgctactggtttctccagcaactggtgtcactttaatattactgatggtataggcagtagtcggtaattgctctttccctacctgtattgtataagtaacacttccactactattagcagcttggttacttggatcagtccaattaacagtttgtgggctttttacaacagtgaccgctccatcacttgtattaaatgtataagttccataggttgtactagaatagttagaaacttctgctaccaaaggcgcagttgcatttgaataagtgtgactaccaccagtgttgccattaaagtttgggctcaatttaactgatcccattactgaattagttgtaaaattaggcgttgtcccagttaatgatacttcaaaaagttgttctccatttggtccataattgcctaaatctttaactgataccgtaccggagtatccactggtatcaaaactgaagtcatctgtagtagctgtaaatccatcgggtaccattacaataaatttaggattttgaactgtagattccccagttgttgataaacggaaactataagttggcactgaatctccactgtacgtttttccatttgcatcaagaattgcagtccctgtaaatgtaggaagcaaatttgtatttattgcatagttaataatcgaactggcactactttttactacggctatattctgtccattagctacaaaagtataattagcatctgttgatgcacttggtttcgcatcacttgcaagttctgaaactattggagccccattgcttccatagctataggttcctgtctgagttggatctagtgttaatttaaattgtccaccaaaattctgtgccacattccagccagggttaaagtctaactggattttaaacaactgctctccatttggtccgacttttcctaaatcttcaattgaatagttacttggcgaatattgattagatccattaaattgaccaccaaaataattaccaacatttttgtctattaaactaaaatcagttgtactcgacgtaaaacctttaggaatcattacaataaattgtggattattaactgtagaattaccaagtgtagaaagacgaacagaaagtgttggtatttgtgactgtggcgtattactcgtgtagttaatactattaccagaaacaaaagcaccagatgaatttaaattaccgaaagaagcaactcctgtaaattgaggtaattctacagtgttgttaagactataattaatcgagccttgttgattattaataccagtagagtttttaacaacctcaattgcttgcccatttacattaaaagtatacgagccacctccataggggcttgttccatttgctaccgcataattagatacttcagaaacaaagggagcgccatatacattatacgaaactacaccttttgcatttgcatctaaagttaatttgacttgaccaccaaagttattcccccaagttggtgttgcaccagttaaggtgatcataaatagttgttcaccatttggaccgtaatttcctagttcttttattgtcgatgttccattataaggtcctgcaaatcctccaccactaaagatatcaatgccttggctattagttaaagtagaaaaatcagccgtagtagcagtaaatcccttgggaatcataattataaattgagggttcgtaacggtagagtctccatacgttgataagcgaaatgtataggtaggtacagccccatctttaaagtctgttccattaatattactgccatcagcatttttaatcattactgtaccagaaaaagtaggtttaacaactgtttcatttgttgtagccaaagttacaaaattagcacctaaagcaattggtaattgagaatttgcagtcgaattatttcgttcaattgtattattcgtagctagaggcaaattgacaagagaagagatatttttatttaaatctaaactcgcctgcaatgtagttggaatattattcgaagttgaggtatatgcagaagtaattgtagattcacttacacgtgatggattagctgatctattaatacctgtagaattctctccaacgtttttattactttttaatactgtactatgttcattagaagatagatgggatctatttatcttttgagtattagatcttttttctgttgatttatttttggccagacttagagaattaagtatgctttccgattgactcagtgaatgtgagaaactttgagattgagatacgatatcagaaatactttcagactgacttatagagtcagaaacactttctgaaatttttagactcttagaagtagatgaactttgtgcttccgaattactaatgctattttctttttcagtagatttactatttacttgatttgaaaccccagttttggtactttctgatactgatcccacaatttgagatttaccatctacagaagtttgtgctgcatatacacgatcattgggtaaaatcgcaatgccagttgttccggtacctaaaattgctgctaatgcagcaagttctttaatataggactttgaattatcactctgatcctttaatctattggggtctacatattttttcttttgactatcttttcttttatttttaaaatttttctcttccatgctttttcccaatccatatcataaattacaaaatataaaaaatattaattgagcatataaataacgcattactatacacatctataatatatcttttgtaattaaattaaaacacaagcacttgatattaaggataatcgcttctaagatcagataaaatggttatttatcggcttaagtctatagtcaaaataatgagtattatataaaacaaatcacaacaaagttacctaaaatcctagtattaaagtacaaaaaaatacacgattctataaaattctcctcttatagaatcgtgtatttttaattattaatttttataaaataatcttaatttattaaatcacaaactttttaagagcttttgcaatgccattatgattattatcatcggttacgaaatcagctttttccttaatatcttcaattgcatttcccattgcaatcttcttaaagcttgaattctcaaacatagaaacatcattaccttgatcaccaaagaccatgacatcttcggggctgatctttaaacgttgcgccaaatccattaaagcatttccttttgaagcaccaattccatttagctcaatacagttatctaaactatgaactatatcataagattcaaaggcccaatacggaatagaattccatagtttttcaatttgatcactatcttttgcacaagtaaatcctaccttgttaaaggtaaaatcttgcggaatctctttacgttcacgaactctaatttcattatcagtcaaagcggcattaatttgcatttgtactgaaagatcacgatctaaggtccaaaaacgttcagttgtctcaaaatgtaagttcacatgggcaagtctttgcaagcgaagcattacttcaaagtcacgataattcatctcttgactcatcagaacttttccagacaagtcttgtacaactgcgccgttaaatacaactgcatattcttctggtccttcaagtcctaattgagtttcaaaaggcattaccccagagagaggacgaccagaagcaagaacaattttaactcccatcccatgcgccacttgtaaagttctcaacgtttcaggtgaaattgtatttccactggttagtaaagttccatctaagtctactgcaattagttttaccgccataaattacccctatcttccaaaaatcatatagaaaattacatttattaataatcccattagtgcataaaaggaaactgcattagctttcatttttttctttattaaatacaccagactagcaataaaggccactaagggaaaaacagtataaaaaatgattgcctattcagcaactccataaacatctgtatttaatttatgaatgaattttttctccaacaaaaatagagactaataaattattagtctctattttatattaaccaatataaaattcaatatgctgttttagattttcaaaatcaattggtaaatgaccaccaatctcaccatctaaattcacaggaatcggatccttatctttactctcacctaataattctactttcaaatttttagtcttagtatagataatctgtggatcattaacatgatttccattcaatgccatagccattaaacgtaaaacatctactggatttgcagttttaactacaatcaactgaaatagtccatctgataattgagcatctggcataatccgttcaaatccgccaattgaattggtcattcctaaaagaaacattgataagtctccctcatagactccctcatcataggttaaacgcatcttattgctactgatttttggtagcatttctgcccccttaagcaaatacgcgctataaccaaggacggattttacttctgatggcacaccataagtaagctcggttaacgaaccactagcagcaatattcataaaatattgcttaccggcacgcccaatatccatcttttgtgttttaccagtcaaaattactttagctgcctcaactaaatcatctctgggaatctttaatgcgcgagcaaaatcattggtagttcctgccggaataacagctaattttggtcttttttctaatggagctactccattaactacttcgttaatcgtaccgtctccaccagcaccaactagtaaatcaaaacctgctatggcacatctttttgcctcattttgagcagacaaaggttctggcgtcgttctaaaagcactggcttcaaaaccagcctgttctaatacatttaagatatctgctacattttgaagcatttgctcatgacctgaaacaggattataaatcaatctcgcttttttcgtcatcgcctctcgcctccctaaaatgattaacgactttgaagttccttgttaagcaattggttaacaactttagggttagctttaccacgagtttgtttcatgatttgaccaaccaagaatccaatcgcacgatctttaccattcttaaagtcttcaacagattgtgggttatcatcaacaaccttagttaccattggtccaagaacagaaacgtcagataattgaaccatacccttatcttcaacgtatttcttaggatcagtaccattttcaatagattccttaaatactttctttgcaatcttagatgaaatagtaccatctttgatcatcttgatcatttcggctaagtgttctggagtcaacttaatatctgcaatgccaacttgattttcattcaagtaaccattaacttgagtgtttaaccagttagcagctaaggttggatctgcaccagcagcaactgcagcgtcgtagaaatcacttgattccttagtttgtaaaataacgtctgcgtcgtattccttaataccatattcttcaacgtaacgcttacgacgttcaaatggtgattcaggtaaactttcttcaatttcgtcaatccagctttgcttaatatggtaaggagcaatatctggttctgggaagtaacgatagtctgcgtcgccttccttaacacgttctagaacagttttaccagttgcttcatcaaaacgacgagtagaaagttgaactctaccaccagaaagtaatacttgttgttgacgtttttcttcataagcaagagaacgacgtacgtggtcaaatgagttcaagttcttcatttcaaccttggtaccaagcttttcttgacctgcaggacgaatagaaatgttggtatcaacacgcattgaaccttcttccatcttaacgtcagaagcaccagtgaattgaacaatttgacgtaatttagtcaaatatgcataagcttcttctggatcttccatatcaggttcagaaacaacttcaagaagtggaactccctgacggtttaagtcaacgtatgaataaccgttagcaccgtgcgtattcttaccagcatcttcttcaatgtgcatttcatgaataccaatgcgcttcttcttaccacgaacttcaatttcaatataaccatcacgagcaagtggttggaagaattgagtaatctgataagctttagggttatctgggtagaaatagttcttacggtcaaagtgagttactggtaaaacatgtgaatgagttgccaaagcaaccataataccaagacggtaaacgtccttgtttaaacgaggtaagacaccaggcatagcccagtcgataacattagtttcagtgtttgcttcagcaccataactaactggtgatggagaaaaaatcttactctttgtttttaattcgaagtggacttctagaccaatagtcgatttaaaattcattaattaatcctccattcctgtaggtgttttttcgtagaatttattattacgttcaatgaaatcagcaactttaaatacatttccttcatcaaaacgcttagccataatttgaagaccagcaggcataccatcaactaagcctgcaggcacgctagctgctggaataccagctaagttagctgaaatagttaaaagatcattattgtacatcttaattggatcagaaatttcttcaccaataccaaatgctggctcagtagtagttggtccaacaataacatcgttttcttcaaaaatcttttcaaagtcgcggcaaattaatgttctaacttgtgcagccttcttgaagaattcatcatatgcaccagctgataaagcaaaagaaccaagcataatacgacgcttaacttcgtcaccaaagccttcacttcttgattttacataaacatctaataagttcttagtgtcctttgcacggtagccatagcgaataccatcatatctttgaaggtttgaagaagcttcactagaagcaacaatgtaataagtaggaacaacatacttagtatgtggcaatgaaacttcgttaataattgcaccagcatccttcaaaacatcgatttgtttttggataacttcgcgcatttcaccgtcaacagcatccatgtattccttaggaacagccacacgtaagcctttaacatcttggcctaagaagctagtgtaatcaggtacttcttgttcagaaacagttgcatcatgttcatcaggaccagcaattacgtttaatacttcagctgaatccttaacacgcttactcattacaccaatttgatccaatgaagaaccaaaagcaataagtccccaacgtgatactctaccgtaggttggcttaataccaaaaataccattgaaggcagctggttgacgaatagaaccaccagtatctgatccaagagctgcaacaacttcaccactcgcaactgcagctgcagaaccaccggatgaaccaccaggaactttatctaagttccatgggttatgtgtttcaccatagtaagaatgttcagtggatgaacccattgcaaattcatccatgttagtcttaccaacaaaagttgcttgtgccttctttaatttgctaattacagtagcatcataaacgggcatatagttgtaaagaatgtggctagctgctgtagtcttcataccattagtaatgatattatccttgatagcaataggaataccagctaatttatttttattaaaatctaaattttctgctggctttgcttcttcatcaacagtaatccaggcattaatctttttgtctgtttctttaatgtttttaactgtttccttagctaggtcttcagctgttatttcgccatcttgtaattttttatttaatgagtcaatgttttcatttaagtaattcattattcattatcatccttatcaataattactggcaccttaatgaagccatcagctttttcaggaacattcttcattaattctgcgcgactttcccaatgttcaggcttgtcttctctaaagtcagtctctcgatcaacaacttgaacagtttcaggaactccttcagtatcaacttcggctaattgatgtgccatattgataatgtcacccatttgttcagtaaacttatcaatttcgtcttcaccaaactcaagtcgagatagtgctgcaacgtgattgatttcatcttttgtaattttcaccgtttgcctcctattcaccgccaaagacgtggacataataactatcgtctgcggaattcttagcgattaatgcctgcgtatcattaacagaattaatcttaatttctattggtgcatccttaggtaagtacttcttagcagctgacaatacaagtcttgaaaaactctcaatctgcgcataaccaaagaattgggtagttacagtaatgttcatttgtgtcaaagttttattttgataatgaacagtcgctgttaccccactaatattagggaagtaaccttgaatagctgctttaaaatcactaaatgaagctgcatcagtagaattgattgctttttcacttccaacagtcggtagcacttgactacgattattgactgttttccaatcatttattttactactatttgcattagcaattccatatgcaaagtaatttccacctacaagagaatctttactggttttactaaaaagtccaaccaaaattgggatatcttttaatcccttctttttacgtaaatacgaaactaacttattagctgcttctttaccaaaagtctcctgttctgcacgagaaatatctttatgatattggggaccatctttaactttttggtagtaatcaaccgagttaagagctagcccaatactcataccatccattttgtaactagaattagatttagtcaaaaaatcttgttctaaaatttgatctaaaataataggattatacgaattctttttattacttttttccgcatttagaccttctggattacttttagactttcttcctagccaatcagtagcatcagcaaccgaaattttttgtccttcttgaaaaacatacttactacttgaaaaagtattgtgagataaatcaattaacccagattctaaagcacgactatctacattattatcactagtattttcagttgttccttctattggactagttacatactctccatcttttaaaagaacattatacccatttttactagtactggtagtttgataactttttttctttgttgtagaagtagtagggttattggcaagatcagaattttttaaattgccacatgcacttaaacttaacccagttgctagtagtagtgctatttgcaaaaatcttttcaatttatttttccttcttattctttatttttcaatttttgcaattgcttcttgttcagttaacattggaacttgaagtttttcagccttatcttttttagagcccgcatctgctccgtagatcaaataatctgtcttcttagaaactgacccagtgacttttgcaccaagatcctgaagcttcttagtaaattcacttcgagtaaaggcagataattttccagttagaactactgtcttttccttaaagaaattatctggtgcttcttcttcaactgttcctaaatattccatatttaatccgctgtcacgcaattcttgtagtagtttctgtgcgcttggttgattaaaatatgctgttaatgactccgcaatcgtctctcctattgtatcgatacttgttaattctggcactgttaattgactaaccttttccaaatttttatatttttccaaaattaatctagccgccttagcaccaacatgatcaattcctaagccgtacagtaataattcagcagagttttgcttactattttcaatagaagacaataaattagtaattgatttttccttaaagtgatcgagttgtcctagttggtccggagttaattgatataagtcagctacatcattaataaatcccttatcaattaactgtttaacaattctaggaccaagtcccataatattcatcgctccacgtgaagcaaaatgaataattccttcttcaatttgagctggacacatcggattaatacagcgaagcgctacttcatcttgcaagtgaaccaaagtttctccacatgaaggacaaacatttggaatctcatacggcttactatctttaggtcttttgcttaaaacaacactagaaatttctggaataatatctccagctttatgcaatttaactgtatcgccaattcttacgcccttttctcttaggtagtctggattatgtaaagacgcacgagagacaatcgttccagcaagtttaactggatccatcactgcggttggtgttactactcccgttcggccaactgtccattcaatatttctaactacagtctcttgctcttctggtggaaacttataggcaatttcccagcgaggtacttttacagtattacccagttcattttgtaaacttaagtcgtcaacttttaaaacaataccatcaattccataacttaaatcattacgtttagcggtatattcatcaataaacttaaatacttcgtccattgattcaaaacgtcgtccagactgattagtatgaaatcctaatcgattcatttcatcaatcgcttgatgttgacttgtaatgtttcttggtggattaacccaagtataaataaaagtacttaaatttctttttttagtaattcgagcatctaattgtcttaaagaaccagcagcagcatttcgaggattagcaaaaacttgctctcctttttcatcacgttctgcatttaaggttgcaaatgcttctttctccatgtagcattcaccacgaacctcagttgttaaaggttcaggtaatgtttgaggaatatctttaataaatttggcattagctgttacatcttcaccaacacggccatttcctcttgtagaagcacgtgttaattttccatcagtatattctaaggataaagataatccatcaatttttaattccacattataagctactgagtgacccactaatttcgtaattctttcgtcaaattctttaagctcatcttttgagaaaacatcccccattgaaagcatcggaacgggatgttcaactttagaaagatcgcttttaatctctccaccaactcgttgggtaattgaatcggcagttactaagtcaggaaattgctcttctaattctactaattcctgataggtcttatcatatactgcatcttcaactaccggagcatcttttgcataataatcatctgcccatttatcgagcttttttcttaattcatcgactttctgagaagcctcattatgagttaaaactgccattatattagcccctctctaaatcaaactgttctatttcattatatctttttaatcggtgcaaaggcagctaaaaggcgtttcactccttggctagcaaaggcaatatctaattccatatcttcaccagtaccgttaactttgactacaacgccttttccccatgctttatgtgtaacttgatcaccaacattccaggactttttctcagctccaactgcaccagttgctttcttagcctcctcaattgtcatctttggagggtaaacatgagagttagcttgtttctttctattaatagcaaagggaacagagatgacagaattagatggcattgggttaacaaattctaaatccttatcttcaatctcatcaataaagcgtgatggttgattacgttgcggacggccatacatcattctagaaaaagcattggttatgtagagtttcttttcagctcgtgtaattcctacatatgctagtcgacgttcttcttcaagttcacttggatcttctactgctcttgaaagtgggaagagtccctcttccattccaaccaagaagaccactggaaactctagtcccttagcggcatgaagagtcatcaatgcaacttggttatcttgattttctaaatcatcttgatcacttaataatgagatctctgaaataaaatcacctaaagctgttgaatcttcatcttcgggctcataattatcatcaaaacgcttagtaacagtcagaaattcatttaagttttctaatctagtatctgcttcaattgtgtgttcattttctaaagcttctttgtagccgaaatcagctaatattttttccgttaaacctgttacaccatgcgtcttactatattcgattgcatcttttaaggccgttccaaaagtagctagcgttctagctgggcgacccgtaattggtgctaagctcaaattcttgaaagtctcttctactgtaaagtcattatcattagcaaaaccgttaaacttagccatcgtagttggccccaaaccacgttttggtacattaataattcggttgaaactcattgaatcagcaggatttgcgacaacttttaaataagccaaaatatctttaatttcttttcggtcgtagaacttatgtcctccaacaatccgatacggaatattagctttaactagggcttcttcgacgttacgtgattgagcatttgtccgataaagaacggcaaaatccttgtagtctctttgatgtttttttatttcttctttaatctttgaaatgataaacagtgcttcatcatttccactctgagcacggtaataattgattttatcgccagcgcctttatccgtccaaagtttcttaggtttacgtttcagattatttttaattactgagttagctgcatcaagaatatggccagtagaacggtagttttgctctaatttaatagtagtaacttcatcatcttgatagtcatgctcaaaattaagaatattttccatgttagctccgcgccaaccatagatcgactgatctgcatccccaacaacgcaaatatttttatattgagcagctaaagcaacacaaagttgatactgtgcttcatttgtatcctgatactcgtctactaaaatatagcggaatttattttgataataatgcaaagtttctttatcctttttaaataagacgagcgtttgcataattaaatcatcaaaatccataatttgatcacgctttaagcgatgctgatattcgctatatacttgcgctgttaccttttcaaacggactagctgcttgctccttaaagtcttttggagtaagtaagtcattttttccattcgaaatagcgcctaaaattgcttttggatcgtacattttaggattaatattaagatccttttcaattcgtttaattagtgtcaattgttctgcagaatcagcaattgaaaaattattagagtagccaattttttttgcgtctcgccgtaaaatacggacacataaagcatgaaaagttgacatccaaacactgtcagctgctggtcctaataacttttggacacgttctttcatttcgctagctgccttattagtaaaagtaatggctaaaacattccatggcgcaacgcccttttcttcaattaaataggcaattcgacgtgttaaaactgatgtttttccactaccagctccggcaactactaaaagtggaccttcagtacactgcacggcttttttttgctgaggatttaatcctgcaagaattgtttcttcgctcattgcttcttccttttctgttaactcaaacgctaaaatagacttgtctattataacaaaaaacgacaatagcatttacttaactattgtcgtttttaatttaatcatattgtgttaaattgaattctttaattatatcaattaatttttttgcataacctggatctgtcgcatatccatctgtttctaatgcttgtgcttgagtggcataatctttggcagctaaaacatgctgatattggtttctattccaagtagttccattcacaaataggcttgtatgtgcctcgattgattcttcataagtatcgtaaactcgaaaacgccccgtaacagtttcccaatgatcattaacaaactcagaggtcgttaactcgcgacttgtattcggatccattcccttaacgccaaataaattattgtattttctagaaagctcactctgaccaaaattgctttctagacaggcttgcgcgattgtaacacttggaaagagtccataaggcttgtcagtcctttgggcaattggagccactactttaataaacttttctttactttgaagagactgttctttttctagttgtgcctgacgtaatcgttcattattcacagtttgctgacgccagtacaaaaagcctgataaaattattaccaaagtaaaacaaatcgcaaatgctcttgcaattatatactgaatatttttttgacggcgtctacgcgacattttaactcatcttccttttcatcacttgcttcaaaggcatcgcaattgccggcgtaagaacagcagtaaagattgcttctacaataccattaatgcctaaaacgctaattaaaatagcaattaaaggagctgaattttgagtttgacctaatgaatgaagtaaaacagagggatccttcatgtaccaaagactagtaataccaaccacaagtagcgtattagtcaaagaagtacataatcccgtgattgtataaacaacagtcttttgaaattttgaatcatcctttgccgcttgtccaatcattcctgcgataaaacccgcagctgtccgaggaactaaagcaataagaatgtttcggaataaaagcatgctgacaatgtcaccgggctgtgtatatgcaacaaacatgctcaataagccccaaaataaaccaattgatgctccaaaacctggtcccattaaacatccggccaatgcaactgttaaaggaatagttgtaatagagggtaatcctggcaaaatccggatgtagccaatataagggacaaaggtctgaactaaaataattgcaacaaaaatagcactgatggcaattctaaaagtcttcttactaatcatagtctttcctactttattaatttataactttaacaaaaaaggaagccgcaatttgcgacttccttttcttagtggtgcgggcgagaagactcgaacttccacgatctaaaagcgatcacaagatccttagtcttgcgcgtctgccattccgccacgcccgcggtacttaaataatataccagataatttttcttttagcaaatgaaaattcaaattttttatttattttttctgattaatgttaatcttccgccgcatttgccacatctatatttttttgtatttactttacgaacgcgaggatactgaaaatgacaatttttacattcataaatataatttcgattttgtcgacgtcgtaaaccaatatcaggcgtataacgactacctccaacagcagcaagcaaattcttaaaatcacgattacgatgctgataaccgcgacccgctaaatgtaagtgataatgcgttaactcatgcttaattattccaactaaagctgcataatattttttatctaaaaaatgaccgttaatatcaatatgatgatcctttaaaaagtatcttccgcccgtcgttgtcattcgattattaattttaacctcatgtttaaacggaatatgaaaatactgtaaagaaatttcttctactaaattttgtaactctgcttgattcattattttcgtattaatttttgatatattccagcttgttttggagaagatatccttctctttaaatcagtcacaattctttgcttcaaagactgctttccatctatccatgttccagtaaataagtgaatagaatatgaattcttgcttggattacacaaaaatccatccggataaacgtggagaccatcttttaatatttgttctctattgcctatttttagaccgtaattttcttttaaaatatcagttactgaaatactattcacacctgccatttgatcattcttatcaaaagtaaaatctcgattattgtaataattaagaatatccttcataaaaggatgattcatttcagcgccaaaaatagctgctgacaagtaatcattgttttcaaaaccaataaatgcacgattatttaaaagtggatctaatttcttaaggactctaacgtctgtatctaagtaaatgccaccttgctcataaatcacacgggctctaatatagtcagaaacaaatgcccactttttggcctcataggcttgttcaatatacttattttcatgtacgttgaaattattttcattccattcaacaatttcatagtctggcaatttatttttccaggtggcaatgcattcttcaattaaagatgatttagggttatttcctacccaaatataatggatttttttaggaatcatttttgtcttttaatctttccgctgattgtaaaattaaattgaacacttgataaaaaataaaaagtccattcggacctgtttgatagaatgttaataaccacaaaaactttctattggaggtcaaaatggactctttacattctaccatgaaccagcacgttaaaggcaagcatttatcatttgaagagcgagttattattcaattgcgtttgaaagatggctattctttgcgtgcaattgcccgtgaacttaactgttctccttctactatcagctatgaggttaagcgtggcactgtaaaactgtatcatggtaaagtcaaaaaatataaggctactcaagggcatgatgcatataaagctcatcgtaaaaattgtgggcgcaaatcagactttctcaggaaagctcaattcatgcgctatgtccacaagcatttttttaaagatggctggtcgcttgatgtgtgcagtaatcgtgctactgctgttggcgaattcgctagcagcgatgttgtctgcaccaaaactctttataattacgttgatcaaggcttattaggaatttataattacgacttgccagagaagcttaaacgcaatactaagcttcatcgtattcgcaaaaataagaaaaaacttggcagaagcattgaagaacgtcctaaagagatcaataaacgtaatgaattcggtcattgggaatgcgatttagttctcggacataagagcaaagatgatgaggtactgctaaccttatctgagcgtatgagtcgtgagtttttaattcttcgtattcctgacaagacttctgtcagtgtcatgcaggcctttaaagaactccaaaggcaatacagcgaacattggaatgatatttttaaaaccattaccactgataatggctcagagtttgcagatctttccaacctagaaaaagtatccaatacactggtttactatgcccatccttacacttcttgtgataagggaacagttgaaagacacaatggtcttattcgcagattcattcctaagggagaagcaatagctaactattctttacaagacatcattaatattgaaacctggtgcaattctttgccaagaaagatactggcctatcatacaccagatgaaatctttgaaagagaattagatctaatctatcaagcagcttaactaaaagtgttcaatttattattgcaatttgctcttttaatctttctagaaaagcgagtaacaaattcaatcatatcttgattaaaatctaacttcatcataaacataattgccgcataaattactagcatcaaaattgacttaactgccatatttaaaaaactcgaggtaattaaatttggcattaacataccagcaattaaggtaattattccaattaagaaatatttcggtacatcacagaaggcatctttaaaattatagtcatctctaacaatccaaagtcgtaaaattaacactacaaattctgtaattaaaattgctactgtagcaccgctggctccatatggtcgatctagtatagctgctaaaactaattcaattatggccccaattacaactggaatcgcgtattctttatctcttcgattagcaagtgcaaattgattagcaaagaccccacccatcggaatcataataatggttagggcaaagaagaacatcagagatgtcatcggaataaactgttttccaaagaagaaaggtacaaactgcttagtatttgccatgatgattacagcaaataaggttcctagcattgtagtcgcttcaagagacttctttaaaactaccttttgggtctctttttcttcactagccatcttcggcataattaccaaggaaatgcttgtaattacccccaataccatatttgaaattcgctgtgaattatcataaaaagccacctgagttgaattgctgaagaatcctaaaattggcttatcaagagaagtatagatctgtgtagcaatctgaggaatcattaaggtgataatcgaaataatggtggtcttatatttatagaaatgtcctactggtcttcctacataacgatgaatatcaagccaaaatacaaaagatcctagcatggttgaaactgacataatcaggaagtatttccaaagatctgcaggtgatttaattaagagcaaaatcaaaactacactggctaatttaacaatcgtattttttaatacaactctaccaaaatcagccaatccttgaaaaaaccaagaaatatcaacttgagctgagatcaaatatggaaccattaagattaaatagttccaatattgaacatgaaaaatattcgtaattaataaagtgattaaaatagtcactaaacctgcaattgcttgaaaataccacaatccccaaaaagcttcagttaattcttgaggggtaccataagctctagtccgagatactgtcctaataccaatataagagactgataaagtacaaaataccatcaaaaattgcacagtattatttacactgccataaataccataagtcttaggccctaacactcttgataagtatggaacggtgatcagcggtactaaaactagaaaaatttgatagaccgcattatataaaatattaagaaaagttcgcttcactactttttcctctaaaaattcttcgtcatgtaatcaaagataggctcgcaagaatcaatatcttcaacttcatcaattaattcacgccaataaaaacgctgatttttgtattgcttatcatcaggatgtctcaaaacttgcagaagttctttttgtgagttaacacagggtcccggtgtaacatcttcgtaggggcttaataataaaccgcgtactttttcatattgctttagataattagtaataaaaataattggtttatccaaatacaagtaatcaaaataaattgatgaaaagtcagttattaagaaatcagtatctccaagcaattcatataaatcaaggttattttcaaaaagataatcattatttaaaaaagcaacatttgaaaactgactattaaagttatcaaacattcgcatttcatagggatgaagtttcacaatcaagtattggtgattatcctttaaggcatcatttaactcataagggtcaaagcctaaaaaagcaaagaaattaccttgttttatcatttccataacacttggatcctcaagctcgtagcggaaagttggcatataaattccgattttagcttgctcatccttagttttaaataaatcctctaataatttttctttagaaattgctggttgatcaatataatcaattcgaggaaagcccagcttttgatattttttcccctcaattgccatacatgcgctcattaaagtttcgtataaatctgagcttgatgttaccatatcagcatttttatgccaaagcttttgatttcgtttattagcacgatagcgtgtattatgtgccataaatcccatccgctttagcggaacaccgtgccagaattgaatattaatttgtgcgcggcgtgctttaaaaggttggtgcgtagtaatcacatacttggctgcaccaatctttttccacgtttcccaagacaaatgtgacgatggccacggttcaactaaggttacgtcataatccggatgattagctttaatgtatttatagaataaataaccgtttgagccggatctacccgatccgtttagaacaacaatatttttttctttaattggacgaaaactcgctagcaagctcatcccccataagtacaagcgaaaaaataaactcttcattagatattccccagtaacgtacacatatattatgtgttgatttttttattttattctttactaagggtataaaaaaagcctgagtaaactcaagctttttttgattatttgataaaactttactttcttcaacctattaatattttttccttttatagctattacttctcattgaagtttcatataattcatattagagatacttttatataggagagtgcaacatgaatattggggaagcattaaaacaatatcgtaccagtgcaggcctaactcagaaagaatttactcaaaatatcctttcgccagcacattactcaaaaatagaacgtaatttacatgaaatttccgcaaatgatcttcttaaacttttaaaccaaaataaaatacgatattcagattttttctcctctcttaaccaaaatagtatagaagaacaagataaaaaaattagtgatcaattgctgtctgcttactacgatagagatgttgataaagccaaagaaatttatactcaaattagtacatccgataatgatttactcaagttacgagctgaattgatccttgataccttgcaaggaggtcgtcgtaaactttctaacaataaagataaaattctgcaaaaggtcttttcaggcaatcactggaatagtgattctagtaaaattctgatattagctaattttattgaggtttttgatcctcttgatttaccttttttcttaaatcaaatttataaaaaatatcaaaacaatcttgcccaacaacctcttaaaattcaagaaagtgttgcaactttttgtattaattacttatattccgcatcccaaaataaacatattagttcaattgataaggctattcatttattaactcaattaacagaatctcctgaactaggtattgaaaaaattttaggttattactatcactgctactttactaatcagaaagatcaattagaaataattactaaacttttaaagcaaagtaatttaagtaaaataatagatattttacctcaataaactgcatatacgcattttgttaatcaattatgcagaaataatctcttcattacataaattctttatcatttgtctcatcttaaatgaaaagaggatcaacaatgaagaaatttatcaacaaaaaatattttaccttaagtatcttgcttgcatgcttaagtggcttagagttacccttcggaacttggtcatattcagagattttcgctctaattaccgaaaaaaatattcctaatactatcaagatgataacaattattactgctgctcaagttcttttggttgttatcaaatatttaaatacaaggatgctcaatagaaatattgcttgttttaatcaaaatgtgcgtgaatatctaatgaaaagtaactttattgaaattagtgaaaataatgtgtcaaaacaaatttcttttttatcaaatgatcttaatttaatagaagaaaattattttaagcagctttttcaattgatttctatgattgtaacaattatcggaactttaataattgcaatcggcaatagttttctattaactttagtttttatttcatttgctattttttcaagtattattcctaagtttttcagcaaaaaaacagcccaacaatcaaataattggagtacttctactggaacttacataacatttatgtctgattttctaaaaaacattagaacagttttaaattataatgccttagatacatttattaaaaaaggacaaaaaattattactcaatctactgaaaataaaagattacgtgataatacaattgccaaaagtaatttttgggttaatatattcgtttattcttttagctttttacctattggagtaggaataattatggtcatcaaagggatgctcactctagcctcatttgtggcagttcaatattccagtacttggattattaacagtttttacagtattaatagctgccgtaatcaaatgtcttcggcaaaacccatgatagataagctgaactcctttaaaccagaaaaatttaatacagatgtttctaattctaacctagatacactaatacttaacaatattagttttggatataaggcagaagaattagttttagacaaagtcaatttagaaattaaaaaaggcgataagctattacttaccggtaaatctggtcagggaaagtctactctccttaatcttttaactggtcgactaaaacctactaacggaaatattcttatcaatggattatctaataaaagttttacatttagtgaggtacaacagacttctcaaatatttaatgatactttgcttttcaacctaactttaggtaaaaagtttagtgattccaaaattgcagaagctatcaaaaaggccggattattgccatatgttaagcggtatggattaaatgcaattatagaagaaaatgggaagaacttatctggtggtgaaaagaaaagaatagagttagcacgagcttttttatatgaaagagattttttaatcgttgatgaaggaacagcttcgcttgatcccactacagccaatcagatacatgaaatgtttttgaattctccactaactgtggttgaaattgatcatcacattccacccaaaatcatgcacctctttaatcaccattatgaattacacaaccaacaattagaacgtatattttaatttgtaaaaaagacaactagttaacattttagctagttgtctttttacacatatattttactatttaaattctagaaaataatattcatcactttctagcagcttttctttcaaagaatttaacaatttcgacaataattatcatcaaaaatccagcaacaataactacaagccattgcatcccatctaactcagttacatcaaaaatcttagttaaaaatggaatttctactgccgccataactaaggcagaaataagaattgctccattaaaccacttattctcaaatgtttgtgctctaaagattgatttatgaataaatttagagttaaaggcatggaataattggattaatcctaaggtaaggaaggccatcgttaaggcatctgcgtgttgcatagctgcacttccaacatgtggaccaacatgtaaaccaagttgatatgcacctaagaccaaaataccctctaagataccttgataaataatcgagcttgcaacgcctccactgaagaagtttgactttctaccacgtggcttattcttcataatacctggctcaacaggttcaacacctaaagcgatagctggcaaagtatcagtaactaagttaatccacaacaattgcactggcattaagatatcccaaccaagcattgtcatcataaagacagttaaaacttcaccaacgttacaactcatcagataaagaattgccttttggatattagcaaataccttacgtccttgtttaatagcttcaacaattgtcgcaaagttatcatctgccaaaaccatatcagctgcaccttttgaaacttcagtaccagtaattcccataccaataccgatatcagcttgttttagactaggtgcatcgttaacaccatccccagtcatagcaacaatcttattatttgcttgccaggctttaacaattctaaccttgttttctggtgaaacacgagcatagacactgtagtcttgaacatgctcattgaagtactcgtcagaaagtttatcaagttctgcaccagtaattacagccttatttttatctggactttcttctaaaatgcctaaacgagatgcaattgcagcagctgtaatttgatggtcaccagtaatcattactgttctaataccggcactttttgcttcggcaacagcagcttttgcttctggtctttctgggtcaatcattcctactaaaccagcaaagattagatcttgctcaacattattagtcgttggatcatcataagctttatctacaatcttgtaagccagtcctaatacacgtaaagcttgttcagccatccctttatttgatgcaagaattgtttctttttcattatctgaaattggcgttacttgaccatctttttcaatttttgttactcgctttaataattcatctggcgctccctttacagccacaaagaacttatcgccataatggttaaccgtagacattaattttctttctgaatcaaatggaacttcttgaacgcggctgtctttcttaagaagatcttcaactttaatattttgatcaaaagcatattgaatcaaggctgtttcagttgggtcccctaaaagccgaccaccatcttcaatctttgtgtcattagctaatatcatcgacatcatagccggattatcactattaattggtgcttcatcattatgaagttcgccgttatagtaaattttttcaacagtcatttggttctgtgtcaaagtaccagtcttatcagaacaaataatatcggtagctcctaaggtctcaacagctggcaattttctaacgattgccttatgcttagccattgtttgtgttcctaaagccaaaataatagttacaatagctggtaatccttctgggattgcagctacagctaaagaaacagccactagaaacatatcgataattaatttattagtcggctcgcttccctgtttggtaaacattccgacgataaagacaatcacacaaattgccaaaatcataatcgttaaagtcttaccaagctgattcaagttttcctttaatggagtagctgtttcatctgcattattaagcattgtagcaatcttaccaacttcggtattcataccagtgccaacaacaataccttctgctcgtccgtaagttacattagtatttgcgtaagccatgttaacacggtcacctagtgctacatcatcagcttttaacacgtcactatccttttcaacaggtactgactcacctgtcaaagctgactcttcaacttttaaacttgcagtcttagctagccgcatatcagctggaacaacgtcccctgcttcaagcaagacaatatcaccaggcacaatatctgtacttggaatttctaaaattgcacctccacgtcttacatgggcatttggtgttgacatctcctttaaagcatcaatcgcagcttctgatctagcttcctgaattactcctaaaattgcattcagcaaaacaacaatcataataattgcagcatcagtccattcattagcaactacaccagataaaatggcagccacaattaagacaataatcataaagtccttaaattgatcgataaagcgcataaacatactacgctttttctttgatgctaaagaattgggcccatctgaagctaatctcttcttagcctcattatcagacaacccattgtctaacgatgtgttcagctctttctcaatttgagaaatctcttgagcatagtatttctctttcaccgtaaaacatcctcccataaacaaaaaagacctatgaccagttatcagtcataagtctcactaattaagataagtccagagatatccatctcggttgttgaacttatcgcaataacttgccgttactctcttatgcatctatagtatattaaactatctagtccgatacaagtttagttctttttacataaatcatcaaaaatagtagttaaaatttataaaattaaagtctaacagcatctaaatcggcatcagtaatatttatcaagtcttcctctgaataactatcagtcagggctacgcgtactgcttgtttctttataatcttatcatttaaatttctgacccaacgcccattactgttatcgttatccttacttaaattattcttcaataagtctgcataacttgaaggatttacatgatattgttgtttctttagagaaaacaatccaatttgaaccatttcatcaactgtataatcttcaaaatcaaatttattcggaatacgactacgtaatcctgggtttgtttctaaaaacttctccatatcgttagtataaccagcaaagataatcataatattagagcgatgatcttccataaactttaatatttcatcaattgcttctttaccgaaatcattctgaccaccactagctaaggtatatgcttcatcaacaaacaagatcccacctaaagctgattcaagaacttttctagttttttcagctgtttgaccaacatatcctgctactaaatcagctcgagatgtctcaattaatttatcttcagctattacgcctttttcatatagaacatggccaacaatacgagcaactgttgtttttccagttcctggatttcctaaaaacaatgagtgcaacgtttgagaactagtatttaaacctttctcttcacgttttttatttaaaacagtgactgcaataaattctttaacttgttgctttaccgtttctagaccgatcatttcatcaagctgctgcatacctgatttttgaggacctttttgtagatccttttggtctttttctgctttatttgcctgcttagagttagattcttttttctgggtagtaaagtactcaatatcgttttgtaaattatcttttactattgtgtattgattattttcatccaaatcatactcatcattagtagaatcaaatttcaatacataaacttcagggacattaaaagttacattatcttcaattttaatattaggtgaactttcaaaagctagaccaatccagtctagctttatattactttcacctttagcaaaaatgttaattttcccattatctctaccatcaagtaaaagagtttctccagttaaagcactatgatcttctataataattgactcaacaattctacttgtatttcctacatctatcttactttgattatagagatataaagaatcaattattgaattttctacttttgcctgagcagctttttgtaaataaagggccccagaataattaggttctttaataattgaagaggtaatattgagaatagattcactactaaaaatgcaaggataatctttttcttttactccacccgttacagttacattctgtaatgtagcaacagtattcgaatataaactaaggacattactttcaccatagctaagcgtagtattctgaagagttaaatttgcttcagtagcagtaattttacaattaagagtactattctttatctctacattccctttttcaacataaattctatgtgcaccgtcaccaagtttatcctttttaacgtacaaatcatcaaattgagcagtagcaccatcatctacataaataattggataattttgaccagtcgtagcgtcattaacgaccgaaacatgtgtcgcaattaattgactgttatttgttacttgaagacaattattcttatcttgatagtgtctcagagtcagattatttaattttacctgggcgccatttttaatgataaagccgcctaaaataaaagtattatcttcaccagaaatatttagactcttgttaattacataattttgatcctcaagtggaaactgataatctcttttaatcagaatattgtccccatctgaagcttgatttaatgcatcttcaaattcccaggtagtacgctgctttttgaaaaaacctcgatcatctggtccaactacaaaaaacgtcatatttcctccaagaaaaatacttaactaattttgcttatagaaatcatcaaaaatagttactggcaaatgacgcttatgttcactctttttccacaacttttcaatctgttcagctgcttcttcactcacatctttaccttctaagtaatcgtcaacatctttgtaagttactcctaatgctacttcatcaggtaagtctggacgatcttcttctaaatcagcagttggtgccttttcatataagtgcttaggacatccaagttccttaagcattgccttgccttgacgcttatctagtctaaataatggggtaatatcagcagcaccgtcaccatatttagtgtaaaaaccagagaagttttctgccgcatgatcagtacctacaacagctccattattggcaccagcaattgcatattgaactaccattctttgacgagctttgatatttcctttattaaagtcagtaattttttgaccagttgcttcaactacttttaccattgcatcaactggttctttaatattaacaattagatcttgatcaggcttttgaaaagcaattgcatcggcggcatcacttgcatctgcttgaacgccataaggtagacgaacagcaataaactggtaagacttattcccagtttcttcacgcatttcttcaattgccatttggcagagtttaccagttaaagttgaatcttgaccaccagagatccctaaaacataagtcttcaaaaaaggattttccttcaaataatcttttaaaaagtcaatagactttctaatttcttttttagggtcaatttctggtaacacatgttcatacgcaacaattttttcttgtaatggacgcatcttaatatcctcttttcacaattcgactacgaatatcattaattaagctcatcttgttatcatatagcttttgggataagtccactggataatcttgtggattcaaactacgtttatattcgtcccataatccgtctaagttattagctgcgaattcttttgtttctttaagagtaggttctttataaacaagttttccttcatggaaaatttcttgtagtaaaggacgagcagtataatcagtaacgaccttattaatgtaagtgtattgcggatggaacataaaaagcgcatcaaattttcttggatcttcatcatagcgtgatacccaatcaccctcatttttcttctcagagtttgcttgaatccgccatacctgctttttacctggagtagatactttttcagcatttgaagaaattttcaaagtatcgcgcatcttgccttctttatcttcaattgctactaacttatataccccacctagagcaggttgatcaaaggctgtaattaatttagtaccgattccccaaacatcaatttttgcaccttgcatcttaaggttttgaatagtcttttcatctaaatcatttgaagcataaatttttgcatccgggaaaccagcatcatctaattgcttacgcactttcttagagatataagccatatcgcctgagtcaattcgaaccccttggaaattaatcttgtcgcccatttctttagcaactttaatagcagttggcacaccacttcttaaagtgtcataggtatcaactaagaatacacagtccttatgagtctcagcatatgctttaaaagcatcatattcattattaaatgcttcaaccaaagagtgagcatgagtaccagcgacaggaatatcgaataattttcctgctctaacattactagtagcgtcaaagccaccaatgtatgctgcccgtgttccccaaatagctgcatcggtttcttgtgcacgacgtgagccaaattccattaaaccatcattaccaacagcgaccttaattctagccgccttagtagcaatcaaagtttggaaattaataatgtttaaaattgcagtttcaactaattgtgcttgagctaacggtccttcaacctgcataatcggttcattggcaaaaactaattcaccttctcgagcacttcgaatggttaacctcaattctaaattacgtaaataatcgataaagtcatcatcgtagtcacaagtttccttgagatactctaaatcactttcattaaaacgaagattatttaggtattgaataacatgacttaaaccagcattaactgcgtagccattgccaaaaggttcttttctaaagaacacttcaaatacagaatttctttcacttattccctttttaaaataggtatacatcatattaatttcatacaaatcagtatgtaaaattaatgaatcatcttgatcaacttgtgggtaaaacattttgtcccctcatcactaaaataaataatttttttcttgtattttattataatcaaacaagagcagatatcaaaaagagacatcaaatttgatgcctctttttgatattttaattacttattattcttacataatccctaattgtaaaaaaatctaggatctgttctaactttttctgatcatcttttttaattttgtaaatagtagttccttgactaattattttcattaaatcgtaataaaactgatctaacatattttttgacaacttattactaaactcatcaatttctgttccccaatatatttttgtacctttgggaataacaatttttgcagttttttgagggtcaaaattattgctaaaatcaacaattgttttcaaatatacattatccaattcagaatctttaatatttttaacaactagaggcgtgatttcctttaaagaagtttggccttgtttaaaaattgatggatataaagaagcaatatgaagccgattaattaaattgtataaagtcgcttgtgtggaataggccggcacatttatccggcttacaatatgatgcaaagtcctcaaatttgtagataattcaaataaagttttagaattattttgttttagagaattatcacctaaatttacttttttggaaacccgatattttaatccaacaaaattaccatttactactcttaatcctaaattattttctgcattataccaaacgggcatcccattaattaaataattttcatatacgctggtctcaaatgtctctcttcgccaaaaagcataattagtataaatattttttccaagtcccagggcggtttttattagactaacttcgtttcgataataaggtctaactaaatgaaatttaccatcttttaagcgctgatacatagctctaattccaacaaacattccgtcacatttttcaccaagaatcgtgctaacagcacggtaaaaaacattttgattgaatagaattttatcggcatctaaaacaaaaattatttctccactcgcatacttcagtccgtgtctaatagccttaaaataattatgatgagtttgcttagtatatttaagaggtagttttgtatttcctaagtatcgtcttaaaatttcttctgtttcgtcctgtgatccatcattaattaaaataatctcccaattttgataggtttgattttttattgattctagggcttcaacaatcgtctttgcgctgttataagccgggatgaggacagaaatttttacttgtttcttccctaaactaatatttccaaagatattaacaatagataaagacaaaataaagattaaaactaaataactcgtattaagcacatttgactcagcaacaagcatacttatttcgttaataattaaaaatattattatcccgacaattagatgactagtaggccttaaatgacccttaactttcaaataaaatattgatccaattatttctattaataagatgattgaaccaatactccaagaaagattttttaaaacaaaatcaggcaattcaggtacataccaaactagagaaataagtagaacaatcaagtaaacacacaataaaaaaggacgtaattgttcactaaaagtaaccacaactctaatcagataaaagacaaaagtcaaaactgaaataattaaaattagcaaagtacctgctttgattgataattgagctaaaatatttaaattaagtaatagtaatactaagttctttgcattaaagtgtcgatctaaaaaatataaaatccccatgtaagagataattgtcaattgatataaagcaccaatttctgataaagggaagatatcaagattatttagaaccactgctaacgctaaaaaaactgaaagaagactcaaagttttttctaaaaaccattgatctaaatcttcaagaggaactgataaagctaataagagcaatattaatccataagcagcactaacaatgaaaaagccattatcacccttccaaatattgctactaaattcaaaaattaaagggagaattccaattaaaattgctaaaatcttgcttttatgataattttccactattttcacctaaaacaagtttgtaataattttcgattgctactaattggtttttcattgaaaaagcgtgcatcagatatgtcttttctttttcagccatagccatgagatctgtcttgctcctagccgtagcttgtcttattttttcactaatgctgtctatatctccaattttagcaacaaaaccatactcttcattaggaatcatcttctcaatatcaccaacatcagttgacaaaattggtactaaattatcactagcctctaataagacaagggggaaactttctgaataagatgttaaaactgccaaatccatcttttgatataactttctagtctcttgatgagtcaaaaaaccatgaaaagttacttgcgaactaattcctaagtctcgtgctaatgctcttaaattatttaattcactgccatcgcctacaatatgcaagcgaatattttgatcattgagattttttattgcctttaaaagcaaatcttgtcccttaactttttcagctcgaccaacattaataatattgaaatagggatgagcatattttttaggaacatccttattttgatggaaaaaaatcccattataaattacgcaaatttttgttttcggaatacctactttttcaactagaaggttagaaaagttctgggtaattgcaaagataccatctgctttttttaaagccatgatatttaatttagtaaaaatatttccaatcattcctcgaccttcaaaatcctttaaaggatcagaatgaacggtaataatccactttgctttgatttgctttttaatcattgagacaaacagattagctcttgctccatgagtatggactatatcaaaattcccctcattgataaacctcgtaagacgctttaaaacacttaggtcataacggctttgtgctcctaaaatggttgttttaatttttgcttttttagcagcttttgctacaggtccatctgctaaagttaaaagctcaaaatccacattttgtctttttgcttctgtcaacaaattaacaatatgagaccgtcccccacctttttctaaaccagcattaatatgtaaaactttcatttaattaattctttcccttattttctttctttgatttttcaacttcaactacaaattctggcaatgcgagcatgcgcttaaaacgagttggattagtaattaagcgatagaaccattcaagatgcgttttttgaaatacttctggagcacgtttgactacgccagaaaaaacatcaaaacttccgcccactcccatcataattgcaggcacttttgcctgacgtaggatggagatcagctcttcttgtcttggaaaaccaattgctgcaaaaaccatatcaggacttgattcttcaattcttttagctaccgtctttagatcatccttaaaatagccatcttctgctccgactaattcaattcctggatactcacgagcaatcttttctttggtaattcgcattacttcaggctttgcaccaattaaatatactcgcaattttcttaagtttcctacctgtagcagccaagtaaatagatcataccctgttactcgttctttaagcggtttttttaatatttttccacctaagacaattccaattccatcaggtgtaatcaaatccgcattcttagtaataaggttcataaattttggatctttattagctgccattacaatttcgggattagctgttactaccatggttgataacatattatttaacctactaatcaatctatctttaaattcttctaaagaatagttatcaaattcaattcctaaaatattaactttactcattctctactttttaaccatttctatgtgaaataatatctttacttattattttaacaaaaaagctgtaggaactttttcaatataaaagtttcacttttttatacttctgctagaatagtaactattataagggagtatttattatgaaaaaaattattacctacggaacctttgatctactgcattatggtcacattcgtcttctaaaaagagctcgcgccttaggcgattatttaatcgtaggtctgtcaacagacgaatttaatgaatttagcaaacacaagcaagcctataatagctatgctgaaagaaaatatattctagaagcaattagatatgtagataaagttattccagaagaaaactgggatcaaaaaattaatgatgtacaaaaatatgatattgatactttcgtaatgggtaatgactgggaaggaaaattcgattttctaaaaccttattgtaaagttgaataccttgaaagaactcctggaatttctacgacacaaatcaaaaaagacttgaaataaaaaatgcataatgtagttcatatcacaaaatcaaactgcattatgcattttttatttttcaaatgtaaattcaaatctttcggccacatatgatgcacgaacatattcaaaaggataatgattactgagttcagtcacctggcgtctagttactaatggctccccctttttaactgacaataaacgagcctcattttcattagcaacagctgcaccaatattttctacaacgctcccaatcttatagccacccttttcttcaagcgtttgatataaactacttgaaatttcatctttagaaaaacgggaaactaattcataaggaattgtagccacttcataacaaatcggcacattatctgcaaaacgaacacgttccattcttaatacgttatctgtatcttgaatttttagcttttctttttcagataacgatggcttcgttatacgataagatagtaatttactagaaggaacctggccattagaacgagttatatcggtaaaactcatgatcccagacattttctcttgaaccttttgactagagacataggttccactacctaagcgtctctctaggattccttcgtcttctaatgtcttaattgcttggcgcaatgtcattctagaaacattgaattttgaagctaattgccgctcagcagggatccgctctccaactttatattttttattttcaatatcacgctttatttggttgtgaattttaatgtacatcggttcttgcatgataacccctcacttcattctgctaccacacttattttagcttaaactagctgattagtcattgttcttctttgcttcccaacgcattcccaaaatattaatatttggtctcctattgcattcaacctctaaatcttgagcactacttgaaacaatatttaatttaatcttagcatcatcctggactgcaagcctactcccattgggattaataattaagtctcgtcctcctaaagttgcttgcccatttaaggctaaaaaatactcaaaatcatctcttccagaaaaggcgactctagttgcatctgctgtggccttatcttgaaaatctgcgtgactaataatagttgaattgtttaaggttactttcgcattatcacatgcaattagacggtctattttactattttgaatcaaagttctcgtattcttatcaagaaaaatgctgcctttaaattcagattgtaaaatatttacccatgaatcatctgaaatatagaaactagagtcatcgttcttttcaaccgttgaattgagcatatttacccaagtctgcccatgaattaacccataggaaatagacgtattattcaaatcaacttcagcatttgaattagggtatgtacttagattaccatgaatcatactgttagaaataattgcagtcccttttccctgaatacctaaagctgcgtaattttcagaatcataatcaattaatgaatcggtcattgtaagtctaaagtcagcttgtgcaaataaggaaacactagaattcaaaattttacttgaaaataattctaatgtacattttccatttacagcaattgcggccatatcatcttcatccccataaagggtagtattacgtaaagtaagataggtatcggcatcatcttcaacgtaaatagtattatggcctgattttgtttgaagagcaatattttctaatgtaaaaaagttacaattattctctaacacaaaaaagccactaattaccgtctcgtcgggagtattacctgtccccttgatagtaatattatttacttctaagcctcgatctaactcataaaatccaggagcaagcagtaatacatcatcgggctgcaagtctttaagagcacttttccaagtagtaccgtctcctcgaccactgactttaataagacgcgccatacaaatcgatcctttctacataaaaatttcacacattattccctttattttcaatgttctctgcttaaatataatcatcaatggaggtaactatgattaacattactacaaatcaattagcagaaattttagcacaagattctaacatcaatttatatgatttacgaacaccaattgaatttgcatcaggtcatattcctgatagtcataatcttccttttgaagaattaaaatacttcaatgatcctaaaaatgagacctactattttatttgtcggtctggcgatctttcacatcatgtatgccaacttttaaaatctaaaggttataataatttaattaacatttctgatggtatccttaactggaaaggtaaaatacaaagtataaactaaaaatgcaatataacaaaaaaggtcatcatatgatgacctttttttcgggttgggtgttctttcgaactattgggttagctggattcgaaccagcgcatgatggtaccaaaaaccattgccttaccacttggctataacccatttgattgaacttttacttgttgttcaatgcaaccagctgaataaaattcagcaatggaggccagtggattcgaaccaccgaactcagagagagcggttttacagaccgccgcgtttagccacttcgctaggcctccgaaacgttacttaattataataacgaactgcctagcaaaaagcaagtaaaaattagaaaaaaatctaattttttattttagtattacctactttaattgagcgatatgcttcttaatgatatcagctgattcccttagcttttcatcttcttcagaagttaactctagtggaataactttttctaccccatcttttccaataattgctggatatccaatatatgtttgtacttcatctaaatatacagaagttggtgcaaataatctggcatcactaaatacagcttgaattaagcgaacagcacaagttgcaattgcatatgaggtatatccttttccaaatgctactttcatcgaatttttattaggttgtgcacttaatttttcctcttgttcttttgtgaacagttctttagccgacttaccattaactgagacagttgaccaagcagtaaattgggatgctccatgttcacctaaaacaaatcctgctacatttcttggatcttcattaagtgcttccccaacaattctttgcattctagcagtatctaggaaagttccagttccgaaaacttgttttttagataaaccagtagtttcttgcaagatcgttgaaatagcgtcacatgggtttgaaatattaattaggatgcccttgaagccagattctttaattttagctcctacttccttagcattcttagaattaatttcaaattcaccaaatctatctccagttttaactgtcgcagcaatattaccaaaggaagttacaataatatcaacatcctttaaatcgctatagtcacctagaaacacattaacatgataatcattcctagctaaagtatcacgcaaatcattatattccgcctctgctttagcttggtttttatctaataagtataaattatcaacaattccatgagtaaataaagtaaaagcaactgtcgcaccaacatgtcccataccaattacggctacatttctcattgtaattcctactttctataaaactttctataaaaattcttacaccttaaggataatccatttgccctaagttttaaattcattttatatcttttgactagaaactattttttcatgctgcttaatcttttcaattcgcttctcatctcttttaataagtaacaaaaacaaggcttcaataattgtaaaagctgctacacgagagaagtaatattgattttgtaaaactgtttgtcttaccccggtccttaaatgataatcactatttaaggcaatcggagaatctggattattagtaataccgataattttaattttattctttttagccaactcaatttcttttattagagctgccgattctggggaatgaaatatccatttgatgaaaaacaattttttgtaaattaaaagactagagatggtgcattttttgtatcatctctagtcttttctattagttaacaaaaattgtattttttgccttccaatcgcgaatttttattcctacccaaaagccataaatgccgactgtaataatagttaaaagtagccacttaatccaattcccaaataatccaaaggcacttccagtaaatttcatcctgtgtccttcaattacagtatggttaatttcccaaccataaatcatgcacacagcccaaggatagcaaatccctaatgtacaaacagtaataagtgttcctaagatatgccaaccaataaaagaaattaagcccccatcaaaaaaagaattacgtccatgccttgtttccattatgatctcttccaatccaaatttatgtacaaaaaaagccaggttttacctggcaaatctattgggttagctggattcgaaccagcgcatgatggtaccaaaaaccattgccttaccacttggctataacccatccttcaagccttttacttgttggctctatttgaatgaacttaatcactcaacgattaatatcatattataaatacgaacctctgtcaacaaaatcctctaaaaaatatttattatttttaaaattaattaggagcataaaaaagatcgccttttggcgatctttttaagcataattcagttgatattttagtaccagccgttagtttgccagaacttttgagcaccagtccatgaaccgtaacgtgattttacgtagttatctgctacacgttcttggtttgctgctgagtagtctccaccaaggtatgatgctgataattggtacttaccaatgtattgaccatttcttgctgagtatgaaccacctgattcacggcctgcaatccaagctttagctgctgcttcagaaccagatacgtttgaagtgtagctagttgttgcttgagtttgagcaggttgtgctacttgagtagtttgcttttgtgctggagcatagctgtaagttctttgttgtacaggagctgagtaagtacgttgcacattatagttgtagttagtcttaggagcttgtgcttgtacagcagtttgttgcttttgttgtactggagcttgtacttgagtagtttgttgtgtagaagctacaggtgcttgcttagtttgagcttgtgcaggttgtgcagaagcttgttgtgaagctgcaggagtagctggttttgcttgttgtacttgagtagtttgttgcttttgtactggagcttgtacagtagtttgtggttgtacttgttgtacaggagcttgtgcttgaggagctactggagtagcaacttgggcactagcagcatttccgccttctacagtgtacttagccatgatccattggtttgcaccaagatcataccacttgttacccataacatcgtaagcagttcttataactttccaagtagtaccatgtactaattctttaccagtaaagttggcattttcaacgccatcccaaacggcaacagtagagtttgcattgttaatagttacaacattagtatcattttgaacaatagtagcagcttgtgcgtcattagtattttgtgaatttaaagctaccaaaccagttgcggtaagagcagctgctgcaagtgacttagttaagatagattgaaatttcaagagaaattcttcctttcatatttatcagtcatttaatttacaagttacataatacagcctcaaaatgtcaaaaccatgacatgaatgctaccacattattaaataaaagtgccttatgttacagtttatgtaatatttgtaacttgaacacgctttcttgtaatattcctatataaaactactatgccttatgcatcagccctattctgtcttactgccccccttaatgatttattagaggctaagtgagaaataagacgagaatatcacaaaagtgaattatgtattctccgttctcgaactatgagtacaaaaaaagagatatcataactgatatctctttatatatattcactaacttttagtaccagccgtttgcttgccagaagctttgagcgttagaccatgaaccgtaacgtgattttacgtagttatctgctacacgttcttggtttgctgctgagtagtctccaccaaggtatgatgctgataattggtacttaccaatgtattgaccatttcttgctgagtatgaaccacctgattcacgacctgcaatccaagctttagctgctgcttcagaaccagatacatttgaagtgtaacttgattgagattgtgcaggttgtgcttgttgttgtactggttgagtttgttgtgtactttgagctggttgagtactttgtactgaagagtaagtacctacagaagtcttaggtgctgagtatgaaccttgagtagtttgagtttgtgcagcagtattgtatgaacttgcttgtgaagtaaacaattctgaagcaacattaggatcaacagtatctttacctaagcgagtatacttagccattacccattggtttgcaccaagatcgtaccacttgttaccagcatcgtcatatgcagctctgataactttccaagcagttgcatgtggtaagtattgaccagtcatttgcttatcaggaccgtatgaattccaaacagcaatgctcttgtgtggaaggtagttaattgtaacaactttttcttgttggccaacagtaacttctgcagcctttacagtgttttgagtgttatttacaattgcagcacctgctaaagtaagggcagcagccgcagcagttttagttaaagtagatttcaaatttttattaagcatatccaaaattaaattctctccttgataaatttgatttgaatcattatttcgtcatttctatttacagcttatataatacatggccaatattgcagaatagttcctagaaaattaaggatatatttcatcttgttacattcctgtaatatttgcgccttaagttacaataatgtaacgatgtaatctttctgtagcaaaacaaagaagagagagtcatttttcttaactctctcttcttttctttatccatctattcttaaattggttaaatttctttgtatcagtaaactttaactgcgggaaactcgtaaggaatcgcttctgattccaggataatgtttccattaatttatcaaaggcctggtttaatttaccttcatctaatttcatacgagtatttaaacgctcattccaacttttagtactcatatgtagtttctctacactaaagatagtaagaataaagtctgttcccatcacaattactattattaaagcaagatagccatgcgtttttatttcttcccaagtaattaacttttgaataaatggctgaataacttttacaagaaagactacccctatcccccaaaataaagaaataattggggcaacccggccttgaatatttccccatagatgagaatagtcccataacttcatatggaaaacatactgtaaaaatacactagcgaaatactcaaaaattgtcgctactattacaccaactacatataataggaaaatattattttgaatccgataggtacagattaaaatcgttgttactgcaaagccatatacgggacaataaggcccaaacaaaaatccccgataatcataatgatgatccttaatcgaacaatagattgtttcccatatccagccaattacagaatatgtaaaaaataaaacaataatttcagaaaaagtaaacggcatttttaatacctcataagtaatttttagactcttctatattaaagatatcattctttaatgaaattaaggcgtacaacacctctggaaaaattaactaaaaagcgtaaaaatattcttatctgtaattgaaaggtacatatataatgaagaaacttaataaaacagctagtaaatatgctaatattctacgcttttttaccataattgctttagaaattttaggagctttaatgcttatcctgatgtttagtcaattatttgtaataggtcgtattatgattagcaatcatttaattaacatacctacgaaagttttagatgaaatagtcactttcttcttattctttgaattttcggctatgattgtgacagccttaaagcatatgggtcatacaagcttaaactttttaatgagtctaggaattacagcccttttaagaaatttaattactgcgcatggtgaaccaatgcaaattttaattcatgcagtagcaatattattactaattattggagtagtaattttgaacaaacatatcaaattatagatttagttcataggctaaacgactaggatcctctggatcttcatcaaccataataatcccacgttcaataaaattatggtttaaagctaaatgttgcataatttgatttttacgtgatgtattaattctaaagtttttaattccttggtttaccataattgaaatcaaatctgaaaacataaaattagctaaatgcatcccgcgatacttactgctaatagctaaacgatgaaaagtaacataatcatcgttagtatttttccactctccatttattttctgataagttggctctattccaacaacacttgctgcatagccagccaccttatcatctactattaaaaccaaggcacttttatttttgatatcagttaaaattgtatcttcgtccggataggttccttgccattgactacttccgctttgctttagaaaatcttttgcttcattaataatacccatgatatttgataaatcggcgttagtggcatagcgtgtataaattaaagtcataatctcactcatttcatttttctactagtatacctaaaaagcagagcccccggccctgcttttttaggttatattgaatattaatgtaaaaaagagcctgccaaataaagttttctaaaactttatttgaaagactcttagttaataccctgagtgctgaatgccagatcaatgggtaatctctacaagtccaattatatcaagtacttacagtactaaattattttcgttgtgcactgactgtgcatttaattaacccacgtttccatcatttctttatccacatctttagtaacacctacataaaccttcataaaggttgctaaagaatgccccattctttccgctgcccacgggtaagaaattccaggtttatttgcaagtttagtacaaatagtatgtctaaaactatatagagaaagttttttattcttagaattaatatctaactttttacatactttacgtaacatatcattcataccgctttgagataaaggctttcccattgtagcaaattgatagtttcttaaatttaaaaatactaaatccttattgttatgtatttgatggtctttcaaaaagactttctgtctttccttataatcctgtataaattttgcaagatcttctgaaataggcaatacagtacgagtgaatcctttaggacgtgcctttaaagcaccgttaaaatcttgaatataatcagaccaactatctgatattttaaaggtccaaaaaccatctttttttattagattagaaaattttaaagcttgtacttcagcaggacgcatgccagtttctgcttcaacccatatagctaatttggcatttgaattataaacagtagacttatttaattctttttttacttcatcttttattaattgaagttcttcatcagtaaataaatattgttctggttgtactgtgaaatcacttttcttgaagaactttcttaatgcacgttctggaacaggattttcttgaattgctataccagccattgctttaaaaaagtttctcatatgaactaatctagtagcaattattgaagttttacttacagtagtatgatgggtttctacataaaaatgtgcatattcattaaccatactagtagatacatctttaatcttaatatctttaaaatactttttaaaagatttagccgaatcattccaggccttcaaagttacaggagaaatagtcttttttctatcccctacatattttaaaaaggcatcgctaaatacatcattgcccttagtaggttgagccaaattttcaaatttaagccacatttttctttctagactaatagcttcttttttagtgtctgtatattctacaggacacgaaacacgtttacctgtaactttatcaattggttgtatccgaacttgccacttattcttatattttcctttctcaactttttttatcatgtttctatctctcttctttcaaaaaagggatagaacaaagattcaacttctattctatcctgcacattttatttagtccatttttcttctttatgaaatgctgaggtttttaaccaagtttcaacatcatctaataaataatatgctcgtccccctggtagttgatggtacggcattccggctcttctaaattcataaaacaaagtggtactaatccccagttcttttctcaatgcttttccatttaacagttggatcatatcaaatccctcttttctttttttcaatatcttgtttaattaattcgtcttttaattgttctaagtacttatcaaaatctattccttgtgaagcattttcaataatatttatatcttttttcatagtatcggagtaatgataatgtccattcgtatcagataaggaaatataataattaagaaatttatagaaggattccagcgaatcttttccaaaaacgtctctaatcattacaaccactccaccagctccattttttagaaaccaattaatttttttatttaatgaagcatctgtctgcgcttcttttaattcacttaagccatttccctttgataagtcatataatgctctccattcaggagaatactttttatcattttgcatttaactccttttcttcaataaccaaagaccatctttctaatacacaacttaataaatacggatatatattatctccctcataatttgtaatcagctgtcctatctttttagccagacgatgtttaaattctgcttccaccctaatccagtcattgcaactaagcgctatacttctatacattccatcagctcttagctgttcaacctttttatcatatattcttagaaaagcatcactttttctgcttccaacatataaagtctgaacattgtccatatctcctatagccttatatctcttacgatctatcctattaccgatcatatttaagaatacatatttgccttgttgcaaactttggctaatcgtatttaccgaaaagccataatctataagatcggtagcaatatctatacgtgacacatgccctgaatactgattgcatacactggtaattaaaactttccagtcgattttaatactataaagttgagcaagattctcatataaactcttaccagtagcagtaaaatcaattagaattcccatatctttcctgtttctgttgtacataacagaaattttcccattctctccaccaaactcaaaggaatcagtatagccattatgaccatagctctgagaataagtatcaaatatcttaagaaaatgaaaaattctatcaaccactataacttcttcaggtatttcattatttagaaatttttccatgttcaaattttcataaggaatattcaaacgaatttgatcaattttaatatctgatttcatcatttcacttccctaacacccatattattattaagtgggtgttgccagctcgctccgcttggacattccattcgtgcgactccgtcgcccgccagctggcaacaaattaactaaaacttccagtaactggattcgtcaatataatcaatactagtattagtttgttcgagcctcttaattacaccaggaacgtcaatatttgtcatatcggcagcaataaaaggaataggattatttatcctttgtccgtctgaataaattaatccatatcctggttgattaggtacaaaaggcaatgatttaatatctttaatcatcggataagccatcctataggtatcaccatctgcttgacccatgacaattcttgtccctaattgcaacgtaatatcacgatccaatattgatgcatcaattctctgacctgaaataagagtaaatatacctgcttgtcgacctcgaagaataatctgtctcaattgactaataatttcttttttattgtcgtcggcctcagccaacatagctgatatttcatctataattaataagtaaggttggaaaccatattcggcaaaatcttgtccccattttccattactaaaatgttcataacgattattcatattctcattaattattctaagcattctagcaatttgatttgttgtactcactacaactttatttccattaatgagaattttactcaaactaaacatatcagctcgtttagcatctacaatatataaaccgcagtgtacttgcgacatactttttaacattatataagtggcaagatttgattttccggttccgcttcgtccgataagaagcaccccgccgcttcctttaagattaaatgtgacattgttgtcaattgccataatatagttagaagtcatcattgttgacctccttcttatttgaagatatatctccgagtacgtaagtagtgtgtgttagttgattatcaacagaaatgacagttagatcaaatgcttcctgcaatctgtccgttaattgtctaactcgatcactattcttgataccgttgggataaaaagaaatttctatatcaccattacttattttttcataaatcacttttatgccagcaacaacttgtcgcatgctgaatatagatgttttatttttatcgtcataatcaactagctgggctgattgaattactttttttaatgcataaaactctttgtagtgaattatattaaaatttatccacttccatagtggacaaataacgggtacaatgagaaggaagaaaggatagaacagaacattattgctttcttcattcttaataattctcggaagagtagtaggcaatagtttaatgtaaataaacgttataattagaattataactatcgctaatactctgaaaccggtgggacttcccagcggtttttttgtatcataaacaaacttatgcattttcatcatcttctttctataatttcattgcgtcttgaggagtaagatctaatattctaatattgcttgctgataatccttctgcattattaaaataccaatgagataaatcatcaaaagcaactactttatttttttcttgccccaacaacaaagcttgattttgttgttcattaataatacttcttgaatttttgattttaataataagaacagtaccaattgataattgtgtatttttatcaataattcgtacttgatatacagcacggggaatcatattatcgctctcattagattctggaaccatctcggtagatccacttagcaaaagaaagcatttgcccactacttctactaaaggtctagtcaaagcagcttgaataggtactcttttactcatattttcattaaatgtgtttagcaattcaccgttatcagttacattattttttgaattcatattttttctccttgtaatatataaataagctagcatgatttttgttcgttttatttatgaactattcataattttgctcctttctttattcaatattactatacatctatatttgctccttttcaactgctttttataaaaaaatgttccgttctcacggaacatgatataatttagttaattactacttagaagggtatttaaaatgggcactttaagacttaaatatattagaaaaaaaatgggatttacccaagaagaactagcgaactatttacaggaagtgaagcacttaaaaatatcacgaggaacaattgcaaaatatgaaagtggcgtcaattttccttcaaaaaaaactttgaaagcattatctgaggctttagaagtatctgaagactttttggcaggcaaaggtttacaaaatgaagatatagaagatgcattgcttaatcttttacaaaaaaatttctttatttcatattcaaactcaaatgatagtactcacaacgctattaagaactatcttggatatttaggcatggataacgagccttacaatttttataaagataataatggagacttaaatatcgtaatggtaaacgccaattttccgagatatgaagcaattgacgatttttggaaaaataactttaaatttctctttgaagataaaaaattcaaagaaacattaatcggatctaataaaactgaattaaaagaaaaagttacaaaaaagattaatgaacagtttaataaagatgtcaaaaatcgtaatatgagagccctcatagatctaattgatgaaacaagtcataagataaaaaaaggcattctaaaagaaaacaaaggtgaaatctcaaacaaggatttaggagaaattatagatcatgaaattggaagaatagcatggttttcaaaaaaaataggaatcccagtaacaacgcaagaacaaataaaagaattaaaagctctagacaatttactaaacaaaaaagaattgtaattttttctttaatgcacacaaaaaaagcgggttttcgcccgcttttatcatctttgttctatccttaaattactttctgtgcacatttaatttttttctgtgcaacaaatgtgcattttttaatgttatctattaaagctactatatttaaatatattaaaaacaccatcaaatcaatgtttataatacctaaatataaaaaaatatgctgaatgccaggatcgaactggcgacctcttctttacgagggaagcgctctaccaactgagctaattcagcattaacactagaattataacaaagattttcttctcctgtaaagcatcagtaaaattttacaaataaaaaagtcgaagtaaccactacttcgacttttaattaaaagttagccgtatctggatcagtagctaagtcgctaactccatgtaaactatctaatttgctcatctgctcatcatttaattcaaaatcaaatacatcaatattggctgcaatgtatttatcgtgaactgatttaggtaaaggcaaaaatccgtgttctagagaccaacgaattaaaacttgagccggtgattttccaacttcattagctatttcgttaacaacttcatttcctaacaaaccaccagtgcctaagggactgtatgcttcacttaataatcctaactcttcatttactttcactacatctgattgtaaatcacttggattaagcataatttggttaacggctggttttatttctgcagttttaagcaattcctctaggtgatgctttctaaaattagaaactccaatagctctaatcttacccgccttaactgcttcttccatggctctccagctttctgcatttgcttcagcccagtgatctcgaagagccaatggattaggccagtgaattaaatataaatctaaataatctgtccctaaattttgcaaacttttatcaattgcagcttttgcctctttataaccatgatctgcattccaaagtttagtagtaataaataagtcatggcggttaatgccactattcttaattccttctcctacactttcttcattcccataagctgcagcagtatcaatatgtctgtagccactattcaatgctgcttcaactacatgttttgccacatccccgtctggagtttgccaagtaccaaaaccaataatcggaattttgacaccattattcaatgtatatgtatcttcaactgaattaaatttcatatttttcctcatttctttaattacttacattataaaagtaatttttgcttttttcatgaaatttggatttttacaattaatttatttaaataagtcattaaaagcttcagacattgtcggatgcgtataaatctgatctcttaaaaccgtataggataaatgggccttcatcgctaaagaaatcatattaatcaattcatatgactcaattccataaagtgtagcccctagaattttttcagtttctgggtcaacgagtgccttaaataaacctctattatcttttgcaacctttgctttaggaattgctgtaacgggcaacttaaataacttgtattcttttcctaatttatttgcttgcttctcatttaaaccaacttgagacaaggcgggtgaaataaatacactataaggaactacctttcggtcactaaccatgcgagcacccgtaccaaacagttgatctttaataattctaaaatcatctaaagaaatataggtaaattgaagaccgcctttaacatccccgattgcccacacattgtccacagtagttcttagaaaatcatctacttttatagcgccacgatcagttgtttcaatcgcagtattttctaaacctaagttttcagtatttggtttacgaccagttgctaccaaaattcggtctgcattaatcgtctttctttcttcatttatttgataggtaatttttgcatcacttgtttcatcagtaattttttcaatatcagcaccaagttcaaacttaataccagcatcttccatatcttttcttactgcattactaatatcctcatcttcacgagctaaaaattccttattatgatcaagcactgtaactttactaccatattttgcaaacatgctagcaaattccaacccaatatatcccgctccaataatcgttaaattctttggcatcttcttttcatccatggcttgagttgaatcaaggatatacttgctttcttttaagccagggattggtaacatcactggaactgcaccagtattaatgaaaatacggtctcctttatactgaacctttttaccattaggaagttttacttcaatttcatgatcagcaataaaatgagcttctccgtctaatacagttacagtcttttcatctgcaagcatatgatagtttttctcccgcaattgtgcagtcatttcatttttaccgtttaccgcatccacataagaaacgccgttagctgcttcaataattaatctttttgaaggtaggcaggcaatgttaatacaagtacctccatacatcttattagatttttcaattactaatacttcttctcccttttgtgctagaaacttagctaaggttttcccaccttttccaaagccgataattatgtttttaattgtctccatatcattttcctcttactttttacaagtttattcttttaactattattttatacataaaatattaatttgcatcttttatgcttataaatttttatataaatatctacatatacgaaaaaatgaggatacaaagttgtttcacaattatacagttatggctaatcaacataatatactaatgaaagagaaatactctgatgacactacgttgagtattcaacaaagtaagatttatgatggtcaagatgcttttttatacactaatcatcattattctaaacttaaatttgtaaatttaagttcagcccatgcggccgttgatttaaaagaaaaatattttgcttgtaaaattgccctcttaaactttgctgattatctttcacctggtggcaggtatttacaaggagcaactgctcaagaggaaatattatgtcatcaatctaacctatatcaaataataagtaattttaataaatactatgaatggaataatcagcatataaattatcatctttatcgtaatcgtgctatctatagtcccaatgtcgtctttactaatcttgatggtacattgataaatacaatcaatgtaattacctgcgcagccccctattatagggaagcccaactatataacatttcttatgaagaggcttgcatgactttaaaaaatcgaatgtattttgttaaaaacatagctgaagatcaacaaatagattatttagttttaggtgcatggggagcaggcgcatttggtttttcttcaaaagaagttgctaaaatgtggcatgatgttttttctcatccctcttcaataaaagaagtagattttgcagttatcgatattcacggtagcaataatacacaaattttcaaatcagaattttcaaactaagctattatgataaaattaacttgattcggttattatttatttaaaaaggagtaacgttaatgcgagtattagttatcggcggagctggttacattggctctcacgctgttagaaaattaattgaagaaggaaacgatgttgttgtccttgattctctctacactggtcacagaaaagctgtcgacaagagagctaaattctatcaaggtgacattgaagatactaatttagtaagcaaaatcttacgtgatgaaaatattgacgcagtaatgcactttgctgcttactcattagttggtgaatcagttaagaaacctttgaaatactacgataataatgtttctggaatgatttcactacttcaagctatggaagatgctaaagttaaatatttagtcttctcttctagtgctgctacttatggtattcctgaaaaattaccaattactgaagacactccattaaatccaattaacccatatggtgaaactaagatgatgatggaaaagattatgcactgggctgacaaggctaatggtattaagtcaatcgcccttcgttacttcaatgtagctggtgcttcaagtgatggttcaatcggtgaagatcacggacctgaaactcacttgattcctaacattttaaagagtgctattgcaggcgacggtaacttcactatttttggggatgactataacactaaagatggtactaacgtccgtgactatgttcaagttgaggacctaattgatgctcatatcttagcccttaaacacgtgatggacactaataaatctgatgtctttaacttaggtactgcccaaggatactctaacttagaaattcttgaagctgctaagaaagttactggtatcgacattccttacactattggtgcaagaagaggcggagaccctgactccttagttgctgattcaagcaaagctcgtaaagttttaggctggaagccaaaacatgaagatgttgatgacgtaattgccactgcttggaactggcacaagagtcacccaaagggttacgaagataaataaatcaaaaaaatccattcaatcatcacgactgaatggatttttttattgcaattgattaacgcattttctcatttcttcaatatctaaaatactatgagcaaattcttttctcactaattcatcgggcagatattcatcatacttatcaaataccggtacttcatttggatacactagctctaatgagtcaaaatctttattagcttcttctactaaaatttctaaaaattcttccttacttacatccattgcaaattgcataaaatacggacgactagaattaaagccacgcaaaccaattcgcttagcacacttaattttgattaatctttctaaagctaaaaatgcatatgtccctgtccacggaaagagacaccacatttttccacctaagttaattaagttgctttctagcatacccgaagttttagcagtatcacgcacttctttaagacgcgcagtagcatgtttcattagataggggtattgctttttctcggttaaaattttattcattctttgtaaaatctcaggttgaatatctcctgcaacatccccaaaatatgccggaatacgacctttaacaggatggcaatagacttgatgtcgtttgcgatctacatcctctactacccaaacacgacccgctatcgctatcttatccccaacaggtggcggtttaacaatagttcccagctcttctgattctgacttaacagcatattcttcattttcttgaaaaacagcataaaacttaaaattattaactatgcgctcaccacttagacctacaattaaaccaccattttcagtttgctgaatatgatcttctttaattagatgtctaagtaatactcgataatcatcttgactaacattccgaaaataatgcagtgtcaatactcgcgacgctagctctgcaggcgtcatttcaccattcgaagctaaagtagacatggtctgatggtagagcaaactatatggtaagcgatttggttcaggaggttctacccatctttcttctagatacagttgaaccaaagcaattccttgtaataaagaccatggaataatctcaggaagcatcgcacgggactcaggatgtgattcgcgcattacaaaccacatttccgaaggattgcctctacgtcctgtcctccccatcctttgtaaaaagccagatacagtaaatggtgcatcaatctgaaaagcacgctctaattttccaatatcgatacctaattcaagtgtggcggtagcacaagtagtcatcaaagaatcttcatctttcatttctacttcagcagtttgccgataagcagcggatagattaccatgatgaattaaaaaacgatctggctcatgttttacttcacagtattgtcttaatatctgacaaactgcttcacattcttcacggctattagtgaagactaaacattttttgccgcgtgtatgttcaaaaatataagccattgatggatcagctgtgtttggagcttgatcacttttctcatctaaaactggttgcgcgggatcaaaatcattactatcagcctgtgggccattatcgtaaaagtgttccattgatagccgccaaacttgtccacttccttctactttaggaacagtagttttatgtttagaaccagcccctaaaaattcagccgcagattttgtatcaccaattgttgcagaaagtccaatacgacgaagatcaacatcggccattttagataatctctcgattaaacaaaaagtttgtcctccacggtcagatcttaaaaaagaatgcaattcatcaattacaatatatctcagatcatgaaacaaattaggaatatccatatgtttattaatcatcaatgactctaaagattccggtgtgatttgtaaaataccagagggatgtttaagtaattttctcttttgtgtctgggtcacttcgccatgccaacgccatacaggaatatcaacatcctgacaaagttcgtttaaacgttcatattgatcattaattaatgcttttagtggtgaaatgtacagtacacccactgattgaggaggattttcatagagatcagttaaaattgggaaaaatgcagcctccgtcttaccagaagcagtcgacgcagctagcaagacattatctcgactattaaaaatagtttctgctgctccaacttgaattgaacggagatttttccatccatgttcataaatataatcttgaataaagggagcaaaacgtgtaaaaatatccatttttcacttaaattctaaactcagcaaaatcatcagacttttcattagaaaccgcctctgattcggcataagaaaacttatccgaattaagtaatttttcaacgtcagtctctggattttgccaaacaatatctaataattcaataaaatcacgaataatctcacgtggcgtaatatttgttgatgctcccacacgtgaatattcaatttttatgaacttttgtaaatcatcttctgtaattgttttttcatacccatatagattagcatgcatctctgcaagtttttcagttaagacaagcatttcttctggggtaagaggatcaagcttaataacaggtgcatacatatctctattgccagcttcagaaaatttaccgctagcaagacgtgagcgcaatgcttcatatgaatatactccgcgtctcttatcttcaattgcctgcggggttccacccataataattccaagatacttcgactttccttgtaaggcatcgttgtacattgttaatatcttttcatagttatattggcggctaatactattcgggattttatagatatttactaactcatcaatcataatcatcaagcccgcatatccagcttgtctaaaaaatgatgcgaataattttaaatactcataccaatcgtcatcagatattacaatatcgactcctaattctttcttagcctgtgttttattggcatattcacctctaaaccacttaacaactttggcttttgtttcttcatcatcattgatataggcttgatagtacatttcaagtaactttgcaaaatcaaacccgtgcactaattcagaaagattagaaattactgcataaattttcttattgactgcgtcttcaaaggcgggagtatcatcatttaatcctgtctctgttctaacctgcatttgaaccgaattaatccagcgatccaaaattaaggttaatgctccaccttccggtctagttttggtggaaagattttgaattagttctcgataagttgctaatccttgcccttttccaccctgcagccgtctttctggcgataaatcaccatcaaccacaacaaaatttttatccattacataatttctaatagtttgaagtaagaaacttttccccgagccataccgacccactataaatctaaaagaagctcctccgtctttgattagctctacatcatgtaataaagcttcaacttcggcttttcttccaacagtaatgtatggtaatccgattctaggtactactccaccttttaaagaattcaaaatagtttgagctattcttttaggcacttttctatttttattaatagccatactttagtttgttcctttcaaaaacatatcttctagatcttcttggtaatcttcaattactgtaggtatatcatttataaactcaatgacattatcaccaaattcatcaaaaagtttttcatttatgttatcaattataacggcagccattaaatgatgctctttaagatatttgtttaggtcttttccctttaaaagcaaaattatggtggccatttcttctgagctcaacccatagtcttcctgctcatcgtttacaacagtttcttcaatttgctccctttcttcttgctcagcttgaagttcttcttcagttaataaactgtctcgagttcccgctgcatcctctcgaattgtagataactgggacaggttaaattcaattttaggctgttttaatttttgttcctctatttgatattccttaattccatccctaatagccttaagataatgcttttctatttttctaggttttaaatttcgtcccaaattaaaacataatcttatttcgcgatctacttcatgcaaaaaattacccataatacttttttgaccagtcaatccccagtaagactcacaataccaggtattcttttcttcatcataaaaatattttctaatttgatcaatttcatagctagttgtctttggctctagctgatgattaaatacggcagctgaaaatagttgaattgtcatctgattcttataagcaatataactagtaaaaaaatcaaatccatcattacgtaaatctaaaattttgtgccaaattagaactaaaagatattcaaatttttctatactctttttatacaaggggcaattgctaatcttataattagataacttcattaagttttctgcaacttcgtggttagaaaattgatctgggtataacaattgttcatactttttatcattagtctgttctttaacaaaaaacgtattatttgttttatttatattataaaaaataatataatcgcgaatccatctttcaagataagcactcatttccggtgaaaatttttgagcataatttttattaaaagtaattaacttatctaatccttcttctggatccttaattccaattccatttagtaattcatacaaataaatgtaagcataggaatctgaaattttttcatagatattttgtttaattttcgtacgccaagtaaaatacgttcgtgcctgccccactgttaagtcgtggtaagttggataatatcgtaagaaagactggtggccctcatagtgatcttcatatgaagccactaatttaccctgtaaataaaaattctgttctctacgaaccgatcctggtaaagaatattgataggactcaatcatcctttttatttctttaggaacaagctgggtatcttcaaaatttagattaattttttcttctgtagatttttcttcttttcgaagtatattagatgaccttttccaatttttaaagtttaatttttgctcatgatagacactttcctcatcattttgaatagtatcaggaatataaattaatttttcaggattaggtcgtttcttggacatgagagcgattttaaaagcatattccaatgctttttttattttttgattacttaaccctaagctaacttcaacccacttagctttttttattaaggatgacgctgaaaagccgggtaagtctttaattgttgctgcaaaatctccacaattaatatttaaacttttatttctaggatctaaatttaaaagagcaaaccaattcttagtaatcggtgaactaaaagctaccaaattaggattgtctttaacttcattaatactgttttttccaaaatgtcgtatagcataacttaataattcatcggtattcatggtccccgctcctttcgaacatatattctactatatttttatttatctagccacgaaggtacaataaaaaacgctgaaatcataatgatttcaacgcctttaaatagattcattattttacttggttaataacatcaattccatttaagctgcgaggatagacaataaatggaacattagctaaaacagctttagttaaaaattgttgatcattccctagacctacattatcttttgcgtgagccaacaattgtgattcacatcctccttgagcagctaagtaacaaaaagttaccatttctctctctttatcatctaggccattttgggtgtaataatctccaaagcaattattaaccacttattaatagttccttttttagcaaaatctttcatttgtgatccaaataatctaatttgagtttcttcacctttttcaagacgatttttcatagtagtggtagcttgactaggtaatggcaatttaataccacgattgagcaaaacttgatttgttgcttcaaaaaatggtatcacacgtcccaatcctaaataatcaactgcttgatagattacttcttttgcttcaaccggacttactccattatcaagagcaactggaagcattaaatgatattcttctaggccctgcatccctaacaaatagactaaattagataataattttattttatttggtaagtctatatcatcttgtacttcctcaaaagtaaaatgactaattctttcccaaccttcaggatcatttgcctttaaaactactttatatgcatacaaaaacatactattaaagcatagatttataaataacattatagtaactagtgttatcattttatctaatatgttcacatatatatttatcaaaccattagttatttcaaacctatacgctttttttataaaataacatctttttcttgaaactataagtattaaattttatagtaaagatgattaagttaataaaaagatttcaggaggtatattgttatgacagattatgcaaaaagagaaatgaaagcattagacagaattgctaagaagatttcagatgcagaaagtcacttaacaaagattgaagatagtattgatgataagaaacatcgcaccgctcaacatgaaacaattaaggatattaaatcaattcttaagcacgcaagaaaagtcgacaaagacgaagacaaaatcgaagagttcaaaggtgaaggtcctaaagattcaaccgaaaaccactacgtctatgaagaagaagaagaacctgttatcaacgatctaaagaaggacttcgcagaattagatgacaaacttgctaagttaaatgacttcaacggtggagatattgatgctttcagaactgaacaccactatcttgaaaaggctcaagacatcttgaagaaagccggcaaattaaattagtctaatttacagtaatattttaatttacatacatactctggaccttataatttttcataagatccacattaaaaggaatacaaaatcataatttgataatgtattccttttttatttttcaaaaattaatctagtctaactaaaaagggaagcaatacattgctttcctttttacgtgcgaattcatattaatattttaagagagatacgaaaaaattaagcttcaataccctttccagtgtaggtttctttcattagattcttaatttcactaattaataaagcagaaggatttgttacaacgttttggtcgccataagcttcaacggccatgttttctaccttattattaaaatcagcttcactaattccattagctttaaggcttaacttcatcccaacagcatgtcctaattcaacaactttcttgattaaagcatcaattagttcttggtcgctatttccttttagtcccagactacgtgcaatttctgcataatctttatcagctctaaaagttgaataatgtggacgcatagcaagttttctaggctttttagaattgaatctaatcacatatggcattgcaatagcatcacttaagccacttggaataccaaactcagatgattctgtatgagcaattgcatgtcctacacctaagaatgcattcgcatatgccatgccagctaaagtagctgcattatgcattctacttctagcattttgatcaccattatatgatttttctaagttttcaaaaatcaacttgatagcttccatcgaccagccacgagtaaaatcagtggccatagtcgaaacataactttctactgcatgagctaatgcttcaaaaccagagcgagcaatcaattcctttggcatagtttctacaaattgatcgtcaacgatggcaacatcaggatttaaagaataatcacagagagtatgtttaattcctgttttagcatccttgataattgaaaatggtgatacttctgaaccagttcctgaagtagttggaatacatactaattggatagcattatattttggaaatcttactgttctttttctgatatctaaaaattttgagtaagcatcttcaaaactcatatctggattttcgtagaataatcgcattgccttagcagcatccattacagatccaccaccaatagcaatcacgacatccggcttaaagatattcatccggtgaacaccatcagcaattatatcagtatctgggtccttagttactgcttgaaagacctcatagctctttttaccacgacgttgactaataatatcagtaatttcattaatgtatttgctggctacaccttcatcagtcacgatgaaaaatctttcaacatcaggcatatgctttaaataatttgctgcattatgttcaaaatatgtcttctttggaaccttgatccattgcatattatcacgacgttttgcaactgtcttaatgttaagcaagtctctagcaccaatattatgtgaaaaagtattagcaccatatgaaccggtccctaaagtaagggaaggaagcatattgttgtacaagtcaccaacgccaccaactgaagctggagagttaaccaaaatacggcatgcatccattttcattgaaaactcatcaattactttttcatcttgagaatgaacccccgcagtatggccgcgcccaccataatttagaaggtcggtacaaatcttataggcatcttcatgacccttagctttatacatggtaaatacaggagaaagcttttcagcagataaaggatactttttacccacacccttgtattcggcaataattaccttagtatcttctggtacatctactccacataattttgcaatttgataagccgaacgaccagcaactggaccagcaacagttcctctcttaggatcaatgaatttttcttcgaacttcttaatttcatctggttttaagaaataacaattccaagacttaaattcatcttttacttcgttatagatatcctcatcaactactacagaattttcggaggaacaaatcataccattatcaaaagttttagagaggacaatatcatagacggattctggaatattggcggtcttttcaatatatgaaggaccattacctggaccaacaccgattgcaggtttaccagatgaataagctgccttaaccattccaggaccaccagtagctaaaatagtttgaacatttggatgattcattaaagtacttgttgcttcaagacttggatattcgatccattgaatagcatctttaggagcaccagctttaattgctgcttctcgaataatttcaccagtttttacacaactcttttgtgcttgtgggtggaagccaaaaataatagcatttctagtttttaaagcaagcatagctttaaaaattacagttgaggttgggttagtaacgggagttactccagcaattacgcctttaggttctgcaattttaactaattgtttttctttatcttcttcaataacaccaacagttttttcatgacgaagactattccaaatgttttcactggcaaacatatttttaatagtcttatcttctactactccacgaccagtttcttcaacagccatttttgcaagtaaataactattctgttcccctgcacttgcgatagcttcacaaattttatcaacttgttcttgatcaaaattggccatctcatctaaagcaacatgggctttttctacatagccatcaatcattttatttacatcaattgctttttcttcttttgtcgcctttttatcttgcaccatttaattgggcctcctactcggaaatctaggcatatttttttgaacaatgacagtatagtccttatatccaacacttgtaaatgactttgtgcatctttttacaaattcacaatatgataaaaagtaagaaataactgttttcaataatgttatcggttacattttttataatattgaaaaatatttcacaaaagtatcaagtaatttttttattcataatcttataaaaaatcttaaacactatacgttttatcagttattatagatttttatgttaaaattttaataaactatgaaaggagttttatattttaatgtcaaaaaatagctcagaatcatctgaggttaaaactatgaaacggagtttgacaaatgcccatattcaactaattgcattagggggaacaattggaacaggactatttctaggagttggaaatagtattgagctagctggtcctgcagtaattttcatctattgcttagttggattctttctttttctgttaatgagagcactcggagaactgatactttcagatattaagaaaaatacctatattgattttatttcagaatacttaggaaaaagtattggaacaacaacaggatatttatattggttcagttggttgactctcgctatggcagaaattactgccctaggaatttattttcaatattggtggcccaacctgcaaagttggattcccggattaattactttattagtactattaggtattaatctaatttcagcacgggtatttggaaacttagaatttagttttgcaattattaaaattgtaacaattattgcatttgttattcttgtcttctacctattaattacaaattcttcaacaaagtatgggcatgttagctggaataacatgatgattgatggcggtattttcgccaaaggtcctaaaggttttttattaggttttcaaatggtaatctttagtttcatcggtgttgagttaattggtttaactgctgctgaagcaaaagaaccaaagaaaactattacacgggctattgaccaactgcctgttcgaattattttattttatgtgcttgcaattctaagtatcttattagcaattccttggacaaaggtttcaacttcaagttcaccattcgttcaagcattaggtgcaacaggaattaaaaatgcaggttcaataattaattttgttgttataagtgcagccatttcatcaactaatagctttatctatagtgcgggccgtctattattttcaataaattacaatggtaaaaacaaaatcagtaagcatttaggtaagttggatcatcgacaattacctaaaaatgctttagtattctcaacagttttaattgcattagcacctcttttaaatctctttttaaaggatgcttttacctttatttctgccactgcaacgagtatgtttttattaatttggtcaattatgatcgtgactcatatgacttaccgtaaaaagacaccaaagaatgaacttccaacatttagaatgccgttatatccaatatcagatatagcagtactaatattttttatagcaatgattattgtgttactaatatttccaaattatcgaattccaatgataagtgcaggaataatttttacagttttagtatgtctaactcactttatacagaaaaaaagtaattaatattaaatcctctagttaagaaaactagaggattttttcatgaaaaataataactatacaaaaaaggaagaacaaagataattctcttcgttcttcctttaactcatcactttactccggctgtcagactcgaactgacgacaacctgattaacagtcaggtgctctaccaactgagctaagccggaatattaaaaaagagcacggcgactgcctaccctcgcaggcagtttcccaccaactactctcggcgttaagaagcttaacttctgtgttcggcatgggaacaggtgtatccttcttgccatcgccaccgtactctttctgagcttttacactcaaaactgaatataatctctagcctttaaacctttgagctttggtcaagtgctcgactgattagtactagtccgctccacatatcgctatgcttccactcctagcctatctacctcatcgtctttaaggtgtcttactgctttcgcatcggaaatctcatcttgaggggggcttcgcacttagatgctttcagcgcttatcccttccatacatagctacccagcgatgcctttggcaagacaactggtacaccagcggtatgtccatcccggtcctctcgtactaaggacagctcctctcaaatttcctacgcccacgacggatagggaccgaactgtctcacgacgttctgaacccagctcgcgtgccgctttaatgggcgaacagcccaacccttgggaccgacttcagccccaggatgcgacgagccgacatcgaggtgccaaacctccccgtcgatgtgaactcttgggggagataagcctgttatccccagggtagcttttatccgttgagtgatggcctttccatgcagtaccaccagatcactaagcccgactttcgtccctgctcgagttgtagctctcgcagtcaagctcccttatacctttacactctgcgaatgatttccaaccattctgagggaacctttgggcgcctccgttacactttaggaggcgaccgccccagtcaaactgcccacctgacactgtcctccagaacgctcagctctgtgagttagaggatccatcaaacaagggtagtatcccaacattgcctccggtaagactagcgtcctactttctctggctcctacctatcctgtacatgtttaacaaatactcaatatcaagctacagtaaagctccatggggtctttccgtcctgtcgcgggtaacccgcatcttcacgggtattataatttcaccgagtctctcgttgagacagtgcccaaatcattacacctttcgtgcaggtcggaacttacccgacaaggaatttcgctaccttaggaccgttatagttacggccgccgtttactggggcttcaattcaaaccttcgcttacgctaagctctcctcttaaccttccagcaccgggcaggtgtcagcacctatacgtcatcttacgattttgcagatacctgtgtttttgataaacagttgtttgggcctattcactgcggctgatattttactatcagcaccccttctcccgaagttacggggtcattttgccgagttccttaacgagagttctctcgctcacctgagtgttctccactcgactacctgtgtcggtttgcggtacgggtaaaattgttctggctagaagcttttcttggcagtgtgacatcatgaccttcgctacttttatttcgctccgcatcacagcttgaaatctaaagacaagcatttgactcatcttttttcttactgcttgcacatgtatttccagcaacatgcgtcattagcctcctgcgtccctcctttgctcatatcgaacaatttcagtacaggaatttctacctgttgtccatcggctacgcctctcggccttaccttaggtcccgacttaccctgggcggacgagcctgccccaggaaaccttagtctttcggcggataggattctcacctatctttcgctactcataccggcattctcacttctaagcgctccattagtcctctcgatctaacttcgccgcacttagaacgctctcctaccacgcatataatatatgcatccacagtttcggtactatgcttagccccggtacattttcggcgcagcgtcactcgactagtgagctattacgcactctttaaatggtggctgcttctaagccaacatcctagttgtctacgcaactccacatccttttccacttagcatagatttggggaccttaactggtgatctgggctgtttccctttcgactacggatcttatcactcgcagtctgactcccgtgcattgatatctggcattcggagtttatctggattcagtaacccctgacgggcccctagtccaaacagcgctctacctccattatcattcacacgaggctagccctaaagctatttcggagagaaccagctatctccaagttcgtttggaatttcaccgctacccacaactcatccccgcgatttttaactcacgtgggttcggtcctccagcgtgttttaccacgccttcaacctggtcatgggtaggtcacttggtttcgggtctacatcatgatactctttcgccctattcagactcgctttcgctccggctccgtcttttctgacttaaccttgcaccataacgtaactcgccggttcattctacaaaaggcacgccattacactttaatgtgctctgactacttgtaggcacacggtttcaggttctctttcactccccttccggggttcttttcacctttccctcacggtactggttcactatcggtcactagttagtatttagccttgcgagatggtcctcgcggtttcaatcgggattcctcgtgtcccgacctactcaggatcctgctaagtctctccgcaatttcgcgtacggggctctcaccctctctggcttatctttccagataattctgctatcacttcaagtactatatcgcagtcctacaaccccaactggcaagccagttggtttgggctctttcctgttcgctcgccgctacttgggaaatcgatttttctttctcttcctgcagctacttagatgtttcagttcactgcgtcttccttcattaaccttaacagttaatgataatacctcgcggtattgggttcccccattcggatatctccggatcattgcttacttactgctccccgaagcctttcgtggttcgtcacgtccttcatcggcttctagtgccaaggcattcaccatgcgcccttttctacttgacctatttcaagttgagtttctctctcttctcggtcgctcttcaatctgttttttcgattgtctcggtttttttgcttttgattatattcagttttcaatgtactaacccttgagactttatgtctcaatggaggctaacgggatcgaaccgatgacctcctgcgtgcaaagcaggcgctctcccatctgagctaagcccccatcattgccttttatcaaagcttttttgctttgaatgggcctaaatggacttgaaccatcgacctcacgcttatcaggcgtgcgctctaaccagctgagctataggcccgattatgcttggcttgttattcaagttgtttgaggtaataccctcaaaactaaacaaagtttctcagtgtgcttccgcttggctttctcgatgacttctcttagtgctctcgcactctccatcatctttcgccttccttagaaaggaggtgatccagccgcaggttctcctacggctaccttgttacgacttcaccctaatcatctgtcctaccttagacggctgactcctataaaggttatcccaccggctttgggtgttacagactctcatggtgtgacgggcggtgtgtacaaggcccgggaacgtattcaccgcggcgtgctgatccgcgattactagcgattccagcttcgtgtaggcgagttgcagcctacagtccgaactgagaacggctttaagagatccgcttgccttcgcaggttcgcttctcgttgtaccgtccattgtagcacgtgtgtagcccaggtcataaggggcatgatgacttgacgtcatccccaccttcctccggtttgtcaccggcagtctcattagagtgcccaacttaatgatggcaactaatgacaagggttgcgctcgttgcgggacttaacccaacatctcacgacacgagctgacgacagccatgcaccacctgtctcagcgtccccgaagggaacacctaatctcttaggtttgcactggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgagaggcggaaacctcccaacacttagcactcatcgtttacggcatggactaccagggtatctaatcctgttcgctacccatgctttcgagcctcagcgtcagttgcagaccagagagccgccttcgccactggtgttcttccatatatctacgcattccaccgctacacatggagttccactctcctcttctgcactcaagttcaacagtttctgatgcaattctccggttgagccgaaggctttcacatcagacttattgaaccgcctgcactcgctttacgcccaataaatccggacaacgcttgccacctacgtattaccgcggctgctggcacgtagttagccgtgactttctaagtaattaccgtcaaataaaggccagttactacctctatctttcttcactaccaacagagctttacgagccgaaacccttcttcactcacgcggcgttgctccatcagactttcgtccattgtggaagattccctactgctgcctcccgtaggagtttgggccgtgtctcagtcccaatgtggccgatcagtctctcaactcggctatgcatcattgccttggtaagccgttaccttaccaactagctaatgcaccgcaggtccatccaagagtgatagcagaaccatctttcaaactctagacatgcgtctagtgttgttatccggtattagcatctgtttccaggtgttatcccagtctcttgggcaggttacccacgtgttactcacccgtccgccgctcgcttgtatctagtttcatttagtgcaagcactaaaatcatctaggcaagctcgctcgacttgcatgtattaggcacgccgccagcgttcgtcctgagccaggatcaaactctcattttccttttgaaaatgagctttttatcgtttagctctaaaactttctttgagttatctcaaatttattgcttgcgaattgacttcgcttttgtttgggatttttatatcccgcacactttcagcgaaactttgttcagttttcaaggtactaccgttgtcatgtgacaacttttatattatatcatgtcttttaagctttgacaagaacttttttaattttctcatctctctcaaattacagctttataatattatcatcttttgctcgctttggcaagctttttttgaacttttttatttgttcttttcgcttgcctcaaacagcatgtattactttacaggctttttcacttttcgtcaacatggttttgaataaaaatatatattgcgaatattcatttaattaataatttaattgttcagatttatcatttttcattcttattttaattgagatttaagtcttaaaattcggatataaaaaaattgtgttaagtataatcacttaacacaatttttaattattttttcaattctggggcatctgtcttaaaatcactttgagttgtctttttgccattctgataccagacactattcttactcttcttctcagcctttttcaatcgttttaatgaatcagatttcttatatgaataattctttctcttcacatattcaaatccatctggcttatagaagcgcaaaagatttcctgtaattactcggtctgataaggagagctcggtcgttactgtattagaaatggatgctaattgggcctttactttcttgcttggatgagttattcgctttcctgattgcgtgtagtaataacttccttctactttactatattttggagtaataaagtcaccatttcgctgggcaacaatctgtggagcatttttagccaaaagactatgtccaaactgaatcatattttggtcattaattcctaataaattaaataaggttggtctaacgtcaatctcgccaccataggtatgattaataccacccttaagtccaggcatgtggaacattaatggtacccgttggaattggagattatcaaaattattaaagctatctttatccaataattgggcagacgcctttatggtgatttccagaaattccgtagtgatctccataaagcataatttagagtattcttctctaaaccagatttcttcagatagctcatcaattctccaattgcttgatcaagataatgagcagtttgaacatatccatctactgttttatcacccgtatcagttttatcaatggattgattttttttatctaaatcatatggatagtggttcgttaccgtaatcatctttaaataaaatggctgtggtaagtgctccatatatttaatcgactgatcaaagaaaagcttatctttaattccatatcctaagtaatatccctttttattttgataataagataaaggcatgaaataatcgtagccaaaagacttataagcattatcacgattccagaatgaacctgccccaccatgcataactgcactagtgtagccagccttttgacctagtatagctggagcactttcaaaagtgttagatgttccataacttgacatagcagatccggattgtaaaccaaaaatagagttttctagcatcatttcagcatcggaagtcttaccctgtcctacttgattaaagaaattatcaaaactaatagtatcgttagcatgatacaacttattcaaattaggtgtaacttcttttccatgccacttatagtcaattaaaaattgctggaaactctctaagtgaattaccaatacgtttttattctttgctacaccataatactcagggttaggtgcaatataatttttcttgatataagactgaacagtttttagatcactatggtttgctttagccataattgcattattttgagcagtttttactccgtcgtatactgcaaaagcattcaatcctaaatatttaacaatatagttattatcaaaagttctagttaataaaccaggacgatccttttgtgccatagttaaattagtaccaatcagtactacagctaagccttcaattaaaagtgaaacctttaattttagacgtcgaacatcaattttaaaaactttaaaagctattagtagaacaatgataactacatctaaaaatactaaaaaatctgttccttttgtgatgcccgcaatactttttcctaaattatcagaagtagatccggatgttttaatgatagaagtagataaaaaatcagaaaattctcgataatataatatatttgaaaatagccaaagagataaaagaaaatcaattatgaccataatccagtaggatttcctacccttaaaaaataaaccaattccaattaataaaatagcagttggcagtggatttatcagtagcaaaaaattttgcattgagcccactacacctaaattaaactttgttatataggttaaatatgtttttatccaaaaaaatacaacaactacagtgaaaaagcctaatttagttttagttaaccaattatatgatgcttttaggcgtcccatctaagtcctcctcaactttgttctttcatgatattactactaaaaaatggttttgataaattaaaatagcaaatttaaggaattttaatgactttttactttcttgggcttaaagagccaaccgaatatccataaaatcattccaaaaaagtaggtagtaaaacgccataagaacatccctagagtcaacaaaatatttgaatgaataaaagtagaaaacaatgtctgaaaactaaattctgctccgccagatgctcctggaattggaacaattgccataaacatgataatcataatgttcatctgtgtaacgtctagccaagaaggtgttaaatttaacgctaacaagatcaagtacggaattgaatagaaacatagaagttgaccaatagtcaaaatactggcacctaataattttttcttttcacgttttaagttctgtccttctgcataaaaagtttcaattttctccatcgtattcttacgccatttttcaacagtatttttattcataaatttttccagtaaatccatgagccaattagtagtattttttgtccatcgatatgcaaacataattgctaatagaaaaattatggaacttacatgaagaataaaaccaattaaaataaacaaggctaaccctgaaaatttggttactaccatatgaaaaccaaaaataattgtcgatacgtacgcaaataaaacgcaaatttgataaattataaatttcatcaacagaatagatgtcgcgcgtccaccttctattcccatctgaatcatggctactaactgagaaggttgaccaccggtagacaagggggttatcgcattaaataaagcttgaataattggaattctgaaaaaagaccatgcagagcgatgtggatctccctttttatgctctaaaatccaaataatagcagcttcacagacatacgacaaaaccattaccaataaaactaacagtaagaaagttaaatttaattttttacttgctccccataatgccttaattggtgttttccgtaattcttgccaaataacaaagccactaattaaaagaacaatcagcatccctataaaatgttttttgttcattatttgatttgtcctaactttctaccaatttcatattgttccatgtaaaagtcatgccatattttagcaagatggtcttcagaatattcttgactggctcgagcagataaatcttgatacttctttaatttttcaggatttgatactacggatttaatttgagcgtttaactcagtaaaatccttgcctttcatataatacccgtcaataatagcttgatataaatccaaatcacgtaataaaacaggagtattacatgaaaaagcttctaaaactgacattggaaataattcatcgaaagatggaagtaaaaataagtcagcaatgtttaaatagctaactaattcttctcgtggcacaataccagtaaatttcaggttttttggaggattatcaattaacttcttaaaatgagcatatccatccgtcattttaccgaatgagaatccaccagcccaaataaattgaatatctggattggcttctgctaacttcgcaaagtcatccacaccttttctttcttgaacttgtccatctccgacaattacaaacttatctatcggaatatgcaatttattcctaaaggcgtttttttgtacttgactttgctcataaaattcactttttgctacaaaattaggaatgtatttcactttttcttcgcttattccgtacttcactaatttatcaataaagattggattaactactactatctgatccattcttttataaaaatcaataacgtacttatagaagatactttttgctggttcagggagcttaacagatccctctaaggtttccggcagaaaatgcacatatccaatttttcttccacgactaggtaaaaaactattagcaaaatatgtaggatttatagtatggtaatgcgttaaatcacttgctccatatttattaatagttacataaaaatcttctactaagcgggacctaagtaagcgcactaactctttatacgcagatcccacaccctgtccctgaactgaatccgcctgggaaaacatattaattctaatcataatttacctcagttgttcgtttattttgaattgcatcttgataaaaatcttctattttatgtgcaaaagtagctgctgatacatctaccaatttatttttctttatattttcaggaatggtaaatcgatcttcttttaaataatcaagaatctcatttttcatctcatcctttgttttaaaggtgcagcctaactccttattatcaaaaacattctccgtgtaatcggtactgtacactacactttttgttccagctgctaatgcctcaatataggttaaaccttgcgtttcagtatcacttgcagatacgaataagtccgccatacgataataatttccaacatcactatgttcaacactacccgcgaaagttacatagtcttctaaagaaagtcgagtaacttgatcttttaatggctgtacatcaggaccatcgccggcaattacaaactttacgttaggctctttttctaaaatttcaggtaaaacatctaaaatttgatctattttcttttcagctgctaccctacttagcgtgagaataactttatcttttgaactaagccccaattccttccggacatctcgacggggattttcattgatagctgttaaatcaactcctgttggaataatacgcattggaattgtaactccatatcgcctcaatgtttcttttacacgctgacttggtgcaaccactccatccatcttatgtagataggccttcgtaatctgtttaacgtgatatggctttaataggtgtccatttaatacataatgtaagtagtcttcatacatagtatggtaagtatgaatagcaggaatatctaacgaatgcgcaacgtattttccaatcatacccattgcaaactcggtttgagtatgcacaatgtctaattttacttccttagcaattttcgttgcctgaaataaacctctaactgcaattcttctatccgtaaaagagacaaaaggtacactactaactctgaaaatatttggctcaatagtcccctttcctaaatgaggatcagttgtagtaaaaatgaagacagaatgtccatctgcttcaagagaattttttaaagtttgaattgaagttgcgaccccagaaagctgaggaaaataagtatcggtaaataacccaatattcatataaaaatacctccattaaagaacattataaagttagtagaaaggagttgcaattttggataaaaaaaagacgtgagaattaactcacgtctttttgccagaatgtctgaataaatagcggtgatcggggtcgaaccgatacgtcccaggggacaccagattttgagtctgacgcgtctgccaattccgccacaccgccataaatgaaattaatcaggaaattcaggcgaaggcggtgatcggatttgaaccgatgattagggttttgcagacccgtgccttaccacttggctacaccgccaacctctgatcattaacaaattgggatagttggattcgaaccaacgcatgatgaagtcaaagtccattgccttaccgcttggctatatcccaatgttagggcggaatgtggggatcgaacccacgcatgccggatccacaaaccggtgtgttaaccacttcaccaattccgccataatattaaaaacagggatagtaggaattgaacccacactagcggttttggagaccgatgtactacctttatacgatatccctatttaaatggaggccagtggattcgaaccaccgaactcagagagagcggttttacagaccgccgcgtttagccacttcgctaggcctccagaatggcgcgagacggaatcgaaccgccgacacaaggagcttcaatcctttgctctaccaactgagctatcgagccatttacggtccctaccggactcgaaccggtgatctcctccgtgacagggaggcgtgataaccactacactaagggaccatattgcgggaataggatttgaacctatgaccttcgggttatgagcccgacgagctaccagactgctccatcccgcgatgattaaggaggatgtgggattcggacccacgcgcgggcagaacccgcctgacggttttcaagaccgttcccttcagccggacttgggtaatcctccatttataccatcttttaatatggtaatgacccgtacgagatttgaactcatgttaccgccgtgaaagggcggtgtcttaaccacttgaccaacgggtcatacgtttttaacgtacttgttaatcatacctgatttagaaagtgatgtcaacaacttttttcaaaaactttttttgaagtgttgctttttcttactctccgcatcagcaataactatattactaaaaacattctaactatgcaacccctaattttaattttttttactttatttctttttttatctctttaagcctatatggtgctacactaagcgtatacggaggtgtttttatgtctaatgaacgatgtattgttgacaataaaaaaggtaaaaaactaattaaattagctgatggaaatatgatttgtgaagatcatgcaaaacttactccttggcaaagagaagaattaattgaaaaagatgcaaatcaagttaatgagtatatagataaaatgactaatacccatttagctgcatatggcttagaaaatacggaagcatcatacaagcctcttcttcatagagcggctcaaagtgatctaatggaaaatacttccccagaggatacattaaggcttcaaaactggatcttaatcaagcaaaatgcagaaataattaacctgcttaaagaattaaatacaagaaactagctagtccatataactatagacacattcgttccatctgaaccatgtgtcttttttagactagcaaaaatacgaccttgaaatatgtaaaaatcgctctgtaaactctttatttcattttaaagccaaattcctcctcaggagcctttaaaagccatatagagaagatataaggctcattaccgcataaaggagattccactctaatttttcaagagacggctgctttccctcttttcggccgtataatagacacctaaattttctctgcttattacataactgaactttcgccgctctcttccccacaagggtcgtcttacttataatacggggactaaaaaactttcttagttcaatcaaggtaagtgcctggaagaaaactacgatttatctacttccaagactactttcgtataattcaattgcttttaatttagtttcaactgtatatttgtccatagcaaaatccccaggttgggtgtatggccaattctggggttaacttcatagttatttgattctttttctgtctattcatccatacacttgaacaaagtttttttatttttaaagatacaaaaaaacacactagtgacattactagtgtgtttactttaaagcggagattgagagattcgaaccctcgcgccggtataaaccgacctacacccttagcaggggcgcctcttcagccacttgagtaaatctccaatgggcctaaatggacttgaaccatcgacctcacgcttatcaggcgtgcgctctaaccagctgagctataggcccctttcctttgaagcgggtaacgagaatcggactcgcgactaaagcttggaaggctttcgttttaccactaaactatacccgcaacttcttgcttcctaatggcgcgagacggaatcgaaccgccgacacaaggagcttcaatcctttgctctaccaactgagctatcgagccattacggtccctaccggattcggaccggtgatctcctccgtgacagggaggcgtgataacccctacaccaagggaccatattgcgggaacaggatttgaacctatgaccttcgggttatgagcccgacgagctaccagactgctccatcccgcgatgtttttatataaaaaaagccaagatcatatggaccttgtaggactcgaacctacgacccgacggttatgagccgtctgctctaaccaactgagctaaaggtccaagtttacctctatagcggcgggggggatcgaaccctcgacctcccgggtatgaaccggacgctctagccagctgagctacaccgccatctgtaacttccttcttattaagctacaatcgggaagacaggattcgaacctgcgaccccctggtcccaaaccaggtgctctaccaaactgagccacttcccgaagtgtgcaccctgaaggatttgaaccttcaaccttctgattcgtagtcagacactctatccagttgcgctaagggtgcatcattatatgccgaggaccggaatcgaaccggtacggttgtcaccaaccgcgggattttaagtcccgtgcgtctgccagttccgccaccccggcatgataatgataagcggaagacgggattcgaacccgcgacccccaccatggcaaggtggtgttctaccactgaactacttccgcatttttattcaatttttatgccgattaaaggactcgaaccttcgaccccctgtttacaagacagatgctctaccaactgagctaaatcggcatggtacgggtggtgggacttgaacccacacgtccgaaaacactagaacctaaatctagcgcgtctgccaattccgccacacccgcttgagttttttctgggccaatgagtcgtggcaggctcgaactgccgaccctctgattaaaagtcagatgctctaccaactgagctaacgactcaatggaggatacagggctcgaacctgtgacctcctgcttgtaaggcagatgctctcccagctgagctaatcctccatttagcacggcgactgcctaccctcgcaggcagtttcccaccaactactctcggcgttaagaagcttaacttctgtgttcggcatgggaacaggtgtatccttcttgccatcgccaccgtactctttctgagcttttacactcaaaactgaatataatctctagcctttaaacctttgagctttggtcaagtgctcgactgattagtactagtccgctccacatatcgctatgcttccactcctagcctatctacctcatcgtctttaaggtgtcttactgctttcgcatcggaaatctcatcttgaggggggcttcgcacttagatgctttcagcgcttatcccttccatacatagctacccagcgatgcctttggcaagacaactggtacaccagcggtatgtccatcccggtcctctcgtactaaggacagctcctctcaaatttcctacgcccacgacggatagggaccgaactgtctcacgacgttctgaacccagctcgcgtgccgctttaatgggcgaacagcccaacccttgggaccgacttcagccccaggatgcgacgagccgacatcgaggtgccaaacctccccgtcgatgtgaactcttgggggagataagcctgttatccccagggtagcttttatccgttgagtgatggcctttccatgcagtaccaccagatcactaagcccgactttcgtccctgctcgagttgtagctctcgcagtcaagctcccttatacctttacactctgcgaatgatttccaaccattctgagggaacctttgggcgcctccgttacactttaggaggcgaccgccccagtcaaactgcccacctgacactgtcctccagaacgctcagctctgtgagttagaggatccatcaaacaagggtagtatcccaacattgcctccggtaagactagcgtcctactttctctggctcctacctatcctgtacatgtttaacaaatactcaatatcaagctacagtaaagctccatggggtctttccgtcctgtcgcgggtaacccgcatcttcacgggtattataatttcaccgagtctctcgttgagacagtgcccaaatcattacacctttcgtgcaggtcggaacttacccgacaaggaatttcgctaccttaggaccgttatagttacggccgccgtttactggggcttcaattcaaaccttcgcttacgctaagctctcctcttaaccttccagcaccgggcaggtgtcagcacctatacgtcatcttacgattttgcagatacctgtgtttttgataaacagttgtttgggcctattcactgcggctgatattttactatcagcaccccttctcccgaagttacggggtcattttgccgagttccttaacgagagttctctcgctcacctgagtgttctccactcgactacctgtgtcggtttgcggtacgggtaaaattgttctggctagaagcttttcttggcagtgtgacatcatgaccttcgctacttttatttcgctccgcatcacagcttgaaatctaaagacaagcatttgactcatcttttttcttactgcttgcacatgtatttccagcaacatgcgtcattagcctcctgcgtccctcctttgctcatatcgaacaatttcagtacaggaatttctacctgttgtccatcggctacgcctctcggccttaccttaggtcccgacttaccctgggcggacgagcctgccccaggaaaccttagtctttcggcggataggattctcacctatctttcgctactcataccggcattctcacttctaagcgctccattagtcctctcgatctaacttcgccgcacttagaacgctctcctaccacgcatataatatatgcatccacagtttcggtactatgcttagccccggtacattttcggcgcagcgtcactcgactagtgagctattacgcactctttaaatggtggctgcttctaagccaacatcctagttgtctacgcaactccacatccttttccacttagcatagatttggggaccttaactggtgatctgggctgtttccctttcgactacggatcttatcactcgcagtctgactcccgtgcattgatatctggcattcggagtttatctggattcagtaacccctgacgggcccctagtccaaacagcgctctacctccattatcattcacacgaggctagccctaaagctatttcggagagaaccagctatctccaagttcgtttggaatttcaccgctacccacaactcatccccgcgatttttaactcacgtgggttcggtcctccagcgtgttttaccacgccttcaacctggtcatgggtaggtcacttggtttcgggtctacatcatgatactctttcgccctattcagactcgctttcgctccggctccgtcttttctgacttaaccttgcaccataacgtaactcgccggttcattctacaaaaggcacgccattacactttaatgtgctctgactacttgtaggcacacggtttcaggttctctttcactccccttccggggttcttttcacctttccctcacggtactggttcactatcggtcactagttagtatttagccttgcgagatggtcctcgcggtttcaatcgggattcctcgtgtcccgacctactcaggatcctgctaagtctctccgcaatttcgcgtacggggctctcaccctctctggcttatctttccagataattctgctatcacttcaagtactatatcgcagtcctacaaccccaactggcaagccagttggtttgggctctttcctgttcgctcgccgctacttgggaaatcgatttttctttctcttcctgcagctacttagatgtttcagttcactgcgtcttccttcattaaccttaacagttaatgataatacctcgcggtattgggttcccccattcggatatctccggatcattgcttacttactgctccccgaagcctttcgtggttcgtcacgtccttcatcggcttctagtgccaaggcattcaccatgcgcccttttctacttgacctatttcaagttgagtttctctctcttctcggtcgctcttcaatctgttttttcgattgtctcggtttttttgcttttgattatattcagttttcaatgtactaacccttgagactttatgtctcaatggaggctaacgggatcgaaccgatgacctcctgcgtgcaaagcaggcgctctcccatctgagctaagcccccatcattgccttttatcaaagcttttttgctttgaatgggcctaaatggacttgaaccatcgacctcacgcttatcaggcgtgcgctctaaccagctgagctataggcccgattatgcttggcttgttattcaagttgtttgaggtaataccctcaaaactaaacaaagtttctcagtgtgcttccgcttggctttctcgatgacttctcttagtgctctcgcactctccatcatctttcgccttccttagaaaggaggtgatccagccgcaggttctcctacggctaccttgttacgacttcaccctaatcatctgtcctaccttagacggctgactcctataaaggttatcccaccggctttgggtgttacagactctcatggtgtgacgggcggtgtgtacaaggcccgggaacgtattcaccgcggcgtgctgatccgcgattactagcgattccagcttcgtgtaggcgagttgcagcctacagtccgaactgagaacggctttaagagatccgcttgccttcgcaggttcgcttctcgttgtaccgtccattgtagcacgtgtgtagcccaggtcataaggggcatgatgacttgacgtcatccccaccttcctccggtttgtcaccggcagtctcattagagtgcccaacttaatgatggcaactaatgacaagggttgcgctcgttgcgggacttaacccaacatctcacgacacgagctgacgacagccatgcaccacctgtctcagcgtccccgaagggaacacctaatctcttaggtttgcactggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcagcactgagaggcggaaacctcccaacacttagcactcatcgtttacggcatggactaccagggtatctaatcctgttcgctacccatgctttcgagcctcagcgtcagttgcagaccagagagccgccttcgccactggtgttcttccatatatctacgcattccaccgctacacatggagttccactctcctcttctgcactcaagttcaacagtttctgatgcaattctccggttgagccgaaggctttcacatcagacttattgaaccgcctgcactcgctttacgcccaataaatccggacaacgcttgccacctacgtattaccgcggctgctggcacgtagttagccgtgactttctaagtaattaccgtcaaataaaggccagttactacctctatctttcttcactaccaacagagctttacgagccgaaacccttcttcactcacgcggcgttgctccatcagactttcgtccattgtggaagattccctactgctgcctcccgtaggagtttgggccgtgtctcagtcccaatgtggccgatcagtctctcaactcggctatgcatcattgccttggtaagccgttaccttaccaactagctaatgcaccgcaggtccatccaagagtgatagcagaaccatctttcaaactctagacatgcgtctagtgttgttatccggtattagcatctgtttccaggtgttatcccagtctcttgggcaggttacccacgtgttactcacccgtccgccgctcgcttgtatctagtttcatttagtgcaagcactaaaatcatctaggcaagctcgctcgacttgcatgtattaggcacgccgccagcgttcgtcctgagccaggatcaaactctcattttccttttgaaaatgagctttttatcgtttagctctaaaactttctttgagttatctcaaatttattgcttgcgaattgacttcgcttttgtttgggatttttatatcccgcacactttcagcgaaactttgttcagttttcaaggtactaccgttgtcatgtgacaacttttatattatatcatgtcttttaagctttgacaagaacttttttaattttctcatctctctcaaatgacagctttataatattatcatcttttgctcgctttgacaagctttttttgaacttttttatttgctcttttcgcttgcctcaaacagcatgtattactttacaggctttttcacttttcgtcaacccttttttgcaaaaaattagcaatatttttttagagtgctaaaaaaggcctcaatttgagacctttttgattaattctgtagtttagaatgttttataccgtatgttgcatacacaatgattcccacaattaaccagattcccaccataatttttgtcgtatttggtaacatccaaatgaaatatacgcttagtaatccagcaattacaggcagtaccggataaagtggcatcttaaatccatcattcacaatatcttttcgatgccgtagaggaataattccaaatgaaattaaagcaaatgcgattaatgtccctgcattaattaatgaagctaattccattaaaggaaccaatccagcaaaaacagctgctactattgtagagacaattactgcgtgatcaggaatcatctttttagcatgcacacttcccatggaatccggtaataatccatctcttcctaaagcatagagtaatcttgagccgcccagcaacatagtaatcattgcggtaaagattccgactaatgctccaacggtaatcaatttattccacgcagttaagccaactacttttagtgcataagctgctggatcatcaacatttaattgtttgtaattaaccattccagttaaaactagagaaaaacttacatatagtagaacagcaataatcactgtccccatgattcctttaacaacgtttttttcaggatcctttgtttcagcactgtttgctgctaaagcatcaaaaccaataaatgcaaagaatacagtggctgcagctgtagatattcccccaatccctaatggtggtgtttggaattttttaggataaaatgggacatagttgtcagccttaatatagaacatcccaatcacaataaacaaaataataattgcgactttgataattactgctatattttccacacgtttagataagttagcaccttgatataaaatcaaagcaacgattaacacaattaaaacagcagaaatatttattactccaccttccattggtccagcttcaagtgctttaggcaaatgaattccaattggcgctaaaatattattattaaaatatgaagcaaaaccagtcgcttcagcagaaacagctaaaaaatattctaataataatccccatccaattatccaccctactacttctccatagattactgaaccaaaagaataggcggagccagctactggcattgcagaagaaaattcagcataagccattcccaccataccagaaacaattgctgctaataaaaaagaaatagcaactgctggaccagcatgctgtgccgcttcatgaccaggcaaaataaaaattcctgttccaataactgccccgattcccaacgcaactaaatcacgagcatttaaatgtctagttaagcgagaatctgcttttaaaaaagtatttactggaactttcttaaagaagtttttcattccaactctccttaatttatttttaattattatacctgattttatagctatttctaccctataattaaaattaattaaaaaaagactacgaatttaattcgtagtctttttttaaaatattgctaactatttttcttcttttttatcagctttttcagcttccttgatgtctttcttttcttgttcacgagtttccttgtcaaacaatacatcttcaagaatttcaccatttaagtacaaatgcttatcatcaatagtgaatttaacttccttagtatctggcttagaaacaatcaacttagctgctggggtttcaagatcttgttcaacaactcttctcaatggacgagcaccaaattccttgtcataacccttcttagccaagtacttcttagcatcatcagtaacatgaagcttaatgtttctcttagcaagagacttctccatctttactaagtaaaggtctaagatcttgagcatatcttcactagttaaagaattaaatggaacaattgcgtcaagacggtttaagaattctggtctgaagtaaacttcaagagctttacgtaaagcatcttgatcgtcacccttaagtaacttgtcagagtatccagcatttgaagtcatgataatgattgtatctttgaaggaaattgttctaccttgtgcatcagttaaacgaccatcatccatgatttgaagcaaagcattgaagacttgaggatttgctttttcaatttcatcaagcaaaatcaatgaatatggttggtgacgaatcttttcagttaattgaccaccttcgccatagccaacataaccaggtgctgaaccgatcaacttattaacagccatttggtcttgatattctgacatatccaaacgtaccaatgcatctgccttaccaaataacttaattgctaattgcttagctaattcagtcttaccaacaccagtaggaccagtaagtaagaatgaaccagttggacggttagaatccttaaatacttgcttacgtgcaattgcatcagtaatgatgtcaatggccttgtcttggtcaataacaactttcttcaagtcagaagctaagttagcattcttttgagcttcatttgcattaatttcactcattggaataccagtcttagtttgaattaaagcatacatatcttctggtgtaactttaagttcactagctttgccggcattcttaagatctttcttaaggtcttcaatctctttcttaatcttagcagcttcatcatatttttccttcttagctgcttctgcctttttaccttctaaggcatgaatcttgttcttaattgaagtttcatctttttgatccatacctaaggacttcttagcaccagcttcgtccattaagtcaatggccttatctggtaagtgacgatcattaatgtaacgatttgaaagttctgcagcaagcttcaaagcttctggatcatatttaacattgtggtatttttcatatcttggagctaatcccttcaaaatttgaatagcatccttgatagttggttctggaacttgaactggttggaatcttctagctaaagcagggtctttttcgatttgttggtattcactagtagtagttgcaccaataacacgaatttcaccgctagctaatgctggctttaagatattagcagcatccccagaattattttctgaatcagtagaacctgcaccaacaatattatgtaattcatcgataaagagaataacattcttgtcacccttagccttatcgataatcttctttagtttttcttcaaaactaccacgaagagaagtacctgcaactaattcattaatatttaactcaataatatgagcattctttagtttttcaggaacgtctccatcaacaattctttgagctaatccttcaactaccgaggttttaccaacaccagcaggaccagtcaaaacaggattgttctttttacgtctactcaaaatttcaataacttgatcaataacagcggtacgtccaatgacaggatcatatttacccttcttagcttgttcagttaaatcaacaccaattggcttttccttttgttggccattttgagcgccttgttgaggtgcttgaccagcactatatctcattggttgttgaccactagtcattcttccatcattgaaaaaatctctgtttaattcattaaacaaatcatcaaaattatagtttccattgtcaaagtatgccatgctttacacactcctcatattctcaaaaattttagcactcataagttataagtgctaactactcacatttcttattatagcaggttatccacagaaagcaaaatattatttcctctttttccacagattattttaatttgtgagcaaaataagcgtaaagtgcttaataaagcattttacgcttaaaaagtttgtgaattaatattatgacatagttctaaaattatttatttttattaattttcaaataatttaatcatttattatctttttctttttatgcttgtcctggggtctttgattattgccaggaatattgtttccattattgttttcaagcaaatactgcttaattaactgaactacttgtttattttgcggaagagaagaatgttgtgcatccgatcctgtaactgtcatcgtcgtatagtgctttacctgattttgaaaaatatattttcctgctgccacactactttcaggtactaacccatccgactcataattctctccccctgatactgaatatacatctaaattcttaggaattttctttcgatttttaataaaatcattcagcatttcggttttatggtcaacattactctcattaaagttatatggtgtcccgagggtcatcaatttctttattttgatttcatcactataatctgcatagtatttttctagccaatatgtccaaatcaatccaccatttgaatgtccaaatgccttaaaattattaaatttatattgctgactaagctgagcaaaagcctcatcaaaccaacctgcttgtttcttaatattggcgtaaccatcatgattattttcaaatcctactacaataaacggttcattatcattacgattaattttaccgctatacttcaatgtaccatctttcttcacttgaatttttaatagactatgctttttcagagtatctttatttagcagattaaccaattcattaaaacgctcagtagttgcacttgatcctggaatcataattacaggagacatttgtgactttcgtctttcagctaaatcatgattagcacttttaatccaaaaaaatgttggaatagataaaactatcaaaaagatgaaggtacctagcaaaagcaaacgatttttcgatatcctatctttatttaacatattcatagccagcctcctcatcatttaacaaatcaatttcgtcttgaacatccttggccatcttcacaattggaagatataacaaaatatcgaatgcaaacagcagcattgagaaaattagcgcttgccagtttccatttgtagcaataaaggcatacaaaggtcccggagttccagataatacattgtaggctgaagccggaattaaatgtattgcaatcatacttgcagctaaaagcatatttacaactggtaaaaatacataaggcagtaagaataatgggttaaggataataggaataccaattaaagccccctgattagagccaaatagagttggaataaaactccaacgggcaactctagcaatatcatttttcttaataaaaattaaaatgccaatcaatatcactaaggttaggccgttaccaccaaattttccataagattgatataaagaatttcccacatatggattaggtacattccaacttgagccatgtgtcaaagcatagtttaaattagcaacattagtcgcactatcaccaccagcagtaagagatactaaaggctggccaatgccacaccagtttaacaacaatgctagaagtaataagggaataaaaatacccagatttaaattattctgtccttgactttggaaaaattgataaaagtttgtggcgatcattcgtacatggactaaactagctaaaatcccaattactaatccaattaaccaagtagcaagcatcggacgaaatgaattaaaagctctttgctttattacttgggcactttctgcatggcgatgatgatagtcagttccaagaaatctaaaaatgagtcccgttccaaaaccgatcaagagagcaaataaaaaactattaatattcaaaaaacgccagttaaaagatagttggaaatctctaatatctctaaaacgatatgcacataacagcaaagctagcattcctgaaacaccagccatctgggcatctttttgatataaacgtgcagtatattgtgctgaaaaatatgcagtaaatagtccaaaagttccaaatattacactggtaacgccctgacaggcataccaggatgcattaaaaatctgatcaggtaaccacttatcaaaataaaagatattagatattaaactcgttggagagaaaacactctgccataaaaactgaaaaatacttcctacaacagcaagtggcattagcatcatcagagttcgatcagttactctaaaaaatgctaatctacgaagtcgcacaatagttttaaaaataattttttccataatttaatccttacctctaataatctatttcctagtttaaattaaatattgtaagaaacctattcttttttattaaaatacagcttaaatcggacaagcttctttaaacccagattagacaaagaacatgctataatgatgaggaaaataaaaaggagaaaaattatggctaaacgaagtttttcgattaatgatgaaactgaccgtctactcaactactatttaaatcattcagataaagaatgggacttagtaattaatgaagcaattaaaagctatgtatgtgatcatttaactcaaaagcaagttcatgaagcagttaaacataccggaaaagatgcctttccagctaatgaagttcttcgtactttcaatagtagctggatcaatggcgagtcttaatattcattgcataaagtcataccttccggcaaaataaaggtagcaattctacaaaataagctgacacttgtcagcttatttttatacaactattcttgattaaaaggaggaaaatacatgctaaaaaaacatgcgctagatccaattaagttaatctggttatttgctggttctttaataattaatactggtgttagttttatttggccactaactaccatttatattcataattatcttcatgagacgcttacagtagctgggattgttttattcataaattcagcttttacaatggttggaaatgcagttggaggccttttatttgataaatggcatccttaccaaacccttttaactggtgtcagtatttccaccttatccactttcttgctagtgttatttcatggctggccagcctatccaattttgttaattactttaggcttaggcaacggtattgtagtaactggcttaaattcaattgctactttaattcaaagtcggaatgcctcttatgtgtttaatgtcttgtatttcactcaaaatttaggtttagtatttgggtccctaatggtgggattcattttaccctttggtattacttatattttcttacttgcttttattatgtttgcctttttaagcattgtaatcttttttgaatatcgtggtttaaaccaggctcatgcctctacaaataaaaaaacgactacagctgcccatcaagaaaaaattccttacggcgcaaaaagagctattttctctatcttaatttgtgttctagctgcttggattgcttatgaacaatggaattctaatatttcctcctacatgcttggcttacacatgagcgttcggttatatagtttactttggactctaaatgctattttaattgtccttattcaaccgctattaacttactttgatgactggctaactgcacatcttcatggacgattatatattggttttagtctgtttgggctagcattcttactactaattggagcaacccactactttaactttgttttagccatggccgttctaacatgcggagaaattttagcatttcctgctgtttcaacttttgttaatgatcgtgctagtaataaagacaagggaaaataccaaggaattgttcaatcagttacatcagctggtcgagctctaggaccgctaattggagctttagtaattgataatttttcctatttgaccttatttgtagtttgcactgttttggttttaatttctgtccttctatttgcaatcattaatgcttataacaagaaaaaaatcgctgaatagcgattttttattttctctaatttacaaaaaaagcctaattccaccaacatcggaatcaggctcacacagtgttaggtaccgctattctgaccaaataaaagatacattttcgctaccgtagaaaatgcaccttgctacaacggtacaggtaaatcttagcacagcagccctacttgcacaaccgcttttaaggaagtcaaaatcataaaaaaagagatagaaaatattatttcctatctctatgaaggcgattttattaaattttccatgagatcgttacatatctctctcaccttaaaatagtccttaactggataattagactgaactactaatacatcgcgcgtgtcatttgatatgcggtagtaagttgtatatccatcgcctgaaccatttgaggaatgaaaatcagggaaattataaaaaccagcattatatttagcaggatcagctggagcataaaccgtttgtattgatgaaggttttatgatttctccatttaaaatcgcacttgtagctcgatataagtcactatttgacattactaggcttccagcgcccaaatctccacgtactctatctacggaaacactatgtggtactaaatatccctgagagtttttagtgtacggtactgcaaccttaatatgcctattcttaggaatgtcccaataaaattctgtttcggaaagccctaattttttaatataggtatctttcaccaaactttcataagatttatgggttactttttctaaaacaccagataataaaatatagttaattgacgagtaaaagcgttgattgtactgtttcttatcgaaaactatattatgcttaatatcatatttaattccagcttgattatttttaaagactggcgttccatagctcgattcatcttttctttgtaatccggcttccatagttagaagctgcccaatcgtaatttgattagcatgggatacttgaggatagaatttcgataatttgtcattaagtttaagctttttctgctcaacttgtttcataacgagggcaccagtaaaaaccttattaactgaattaataaaaaaagctgttttgggtgtattatgctcttttttactaacatttgcatagcctgtagactcattaagaattactttattattcttaatcgccaggatattacctgtgatacctgcttgagttagtttttttttatgtctactgccgccttacttttaacattaggcatctttacattagttttattgccccatgccttagtaaagtagtaactatttagcttatagttgactggatgattcttttcttccataaatggtttcacatattgatccacctttaaccatccattccaaccaaggtggatagtatcttccatgaagaatttctttccaccgtcttttgataagttagctatattattgaaaccttgagatgtaagctgcttggtaatcttagcaacgcattcttgatacattgtctgagataaaccagtgtacttagcccacttttcattaactggtggaataatgaacaagacattaacatgttcatgcgcaagttcatttaataccaattcaaagtctgcatattctggtgactgagtataatcaaaatctctttgagaattctttaggtgctttaagtgcttattgtttaactttttgtcaaagaaaccattagaaataccaaacttattatttgttgttccctgttgtccctgttcattagcaaattgacgtaagttgtcataggcataagtacctggcagtttacctgcttctttttgaatcttaggaatgttattagtcatcccaatagatgagaagaaattatcttcattagctaacattcgacgtctagctttcaaatacaaagtttgatacttagacaatttttgtcctgaagctaaagtcattaatgcatactttgttgtctcactagcagttccagctggcatatctaataagcgtcgagcagcataacgagtagctacactgtccttagcagtcaaaatccaatcaactgcttgaagttgagaaaaatacatcccaaaagctgctggattttgaccttgcttagtaaaccactgtggagaaataataaaaactgcttttttattagaaagctgatttactgtttcctgcatagtgaaaaagtgagttaaggattgacttcccggtcctcctagtaagaaaggtcgataatttcttttatatttataagctaagacacttgggtgcaaggcatccattcttgataattcactagaaccataaaatggaacatagtttttctcaaaagcagcttgcttaatcgattgacctttaaagacagtttgagattgtgaaactgaagctttaaagagagcattatctgacttttcaccattttgccatggaattaaaaataaaattattagcaaaatgaaagcacagagaactgggccgaaaatctgccacagtttacgtttattactcatttcttaagctttctacctttgcaatgattttgtttggagtatcccaatcttcacggtgaaattctgatactggtgcagttacatcacacttgtcttgtaattcaagtaacatttgaacagttgccatggaatctaacaaaccattttcaaaaatgttttcatccatttggtcacttaaatcttcaccagttaattcatttaaaatatctaaaacagcttgctttgtatccataataagaaaatcctttcaaaaataataaactacttccagccaaaccataatgtactcaagaaacctgagaaaattaggaaactgaaacaaacaacattaaatgttaagaaaatcgcaaaccactttgtaaatttattatgtgggatttgcttgcggtgcttacgcttaaatcttaaccaaatatcattaatgataattgccaaagcatggtaaataccatatacgatatagtaccacgttaagccgtgccagaaacccataattaagaaatctacaaaatatgctaattgcgacaatctgattctatttttcaccaatttatgcttcattgcaaagaatgtaaaacgcataaagataaaaccacggaaccagaaggatagagtcatgtgccatctattccagaaatctttaatattttgagaaataaatggtttattaaagttcataggagttctaattcccataaaatatgacgtacctaccgcaaacaaggagtatcctgcaaagtcaaagaataaatacatactgtagcagtacatataaccaagcagagcccaagataagcgtaatcccccattagcttgcccataaaaaattgcatctttagctaattgaggaagccataaggtaccaaatacatatccaataataaatttatataagaatccttgaaaaatatatcttgtaccaaactttaaattttcaatatacttatctctttcaggggctttatcgtaatcttctttaaatcttcgatagcggtcaataggacctgatgaaatagttgggaagaaaagtaaaaaccttgcataagtaattggatcaactttcttaattgttttatcacgaagttccataataacttgtactgttttgaaagttaaatatgaaattccgaaaaatccaatcaaatcagcagttttatttggtactaatggtgcaatctttactgccgctagtggcaaaattgctaggataactgctaaacaaaagacagaggttttattccttccagaattaacatatttttgataagcaaaagtaactataaattggaaaatgatgtatccaattaattgaactccctgtagccagtctttaccattaaacattaaaaacaagaatagtaaggaaacgaaagcttcgtatgttttaaagcgccgtccatgatataaaccaataattaatggcaaaagcgcaataaaaagaataacaaagtaacgcggattactatagggttgaatattgatcacgcgttatttacctccttaattacttgtttaatatctactttaccgttttgagagattggcatttcatcacggtagataaagcgttgaggaagcatatatggcataatatcttgacttaatgattcgcgtaatttcttagttagttcagcatcagtatacttctcacgtacaccgtctgctaattctactacagcaactagttgttgaactttatgatccttattgtattttggagcaacaacgccataacgcactaatggattcttagcaagatagaagttaatttcttcaagttcaattcgataaccattaaacttaacctgaaaatcaattcttccacggtagaaaagcatgtcgccatctaaaaatcctaagtcaccagtacgataacttccatgttcactttctttaaagaaagcagcctcagtcttttctggattatttaagtatcccttagagacacttggaccttcaataacaacttcgccttggttatcttcttcacccttggaagtatcaattgaaatctttgtgtcatctttagaaacaccaattggcaatcgatcatacttatttaaaatttcatcagtaatttctacctgagtaacagcaacagttgtttcagtagggccataggtattaaagatatggctatctgggaatttcatcttaagcattttagctgtcttatgacttaattcttcaccacagaataagaagtgagttaattcaggatgatgcttagcatcaaaagtaggatctaagaaactcatttctacaaatgatggagttgaaacccaaacattgaattttaattgaggtaaagttttgaaaagctgcccgatattttcagttacatcatgaggtaaaactactaacttaccaccggcagttaaagcaggatataaactcattacagataagtcaaaagaatatggtgcttgagctaagaagctaggatgttctggaagtgaaaagtcatttaactcccaatttacaaaactaagcagattatcatgactaatttgtacacccttaggcttacctgttgtccctgaggtaaagataatgtaaaaattgtcatccccacttacaaacttactttgatcaatttctggatgattatcagaaacttcttcaggagttaaaactttgatattatccatttcaataggaagtttatcaattgcaattaccaaaggagcttcagaaacttcttgaatcatcaataaacgttcgctattagaataactagcaatcggaatgtaagcatgtcctgctttaacagcaccaataaaactagcaatcatttcaaagttttgaccaccccaaatcattactggagctttttcaggaagatctagttcgttgatcttagctgcatatgcatctgatctagcctttagatctccataagtattagtttcgccaagataatcataagcgatccgttgtggatcttcagtagcaatttgatcgattgtcttgattacatctttaatcatttaatgcgaccctttcagttctagaaatctttataaataaattttgcagccccaatgccactatatgagtacaagtaaactagcactacaagcactgcaaagtaaaagagagttttagcaataaacaagcctacctcttttttctttgtattgctttgtttatctttatcttctgccatgcttacacctcgtaatcttttttctaaattttacaacaatgttataaaataggttatgatttttactatttcttagaaaaatagcatgaactgaagtaattataccaaaaatagccgtagttatggatagttcactaatgttggttacgttttctttcgataaaataacctatccctaagaaaattgtcggtagaattgaaacaaataccaacactattaaaataactcgtaaaagccaatcagtatttgtccaccttttatcattagcagtagcaagagcatatgctgaaaataagataattgtaattaaatttattaagaacataatattgtgtgtatattgatacaagaccaacacactactaccggatatcaaaccactccaacctgctaatcgtacccaaaaagatattttcttaatcatttttaaccccctaataaggcatttatattcgccgatagaattcggtcaacaatcattatttgatcacgcgcatatgcttttgatcctgattcaaataacatcagtagctgcccattttgaacataaatttgttctagatatggcggcataataacaactttttccgcatttccttcatctaagttattcaaagctgaaattgggaaaaaatacaacttagaatctttgcttccataggattgacttaaaataatccaattctgataaaatgcaattccttgaatctgtcggtccattgaagcacttcctgaacctaaggcccaagatacttggcctgttactgctttgatttgatcactagtaattgttcctttaaaatttcccgaacgagcaataggatagctagcaatttgcccttgtccatcagtattaaaaaagccaacaaataattgattatcataataagttacacaagatgctctttcaattgttggtaaagaaattacattatcatatttaataggttgctttttcttattataactatacttttccaatttctttaacgaaaaagacattagtgccgatgaatcatcttgactacccgttacccaaatatttttagcaattggatcataagcaacccctcctaaatgaggtgctcccggaacttgaatagtctttaaatattttcccgtttttttatctaaacaataaatgaccgagcgatgattatgagttgaatcgtaagccgaaattaataaatattttcccgctacagttaggccttgcggagtcattgaatctgcatcagtaatcttctttttattaaaatcataacttggcgttacaacttggcctggtattactacactactgccaattttacttgcacgtggcgtttcataagctgcactataaacatcaggatatttttcatttaattgtcgtttgaaataagccaaattatgatgaccaggactaatacttgttccatcttttgctttttctacatcaggtctagaagtaaaagtagcttttgcctgctcccgtttttggtattgttgataaccataatatcctccgtatgccgctcctgcagcaattccgagaatcaaaaccaacttaaataaaatctttaaaaatttcttcattagctttccctacctaataaataattttctcaattcgatattatacctgaatcctttccttgctaccgaaaataaaaaatgagtatctctcttatatttcttttggttttgtactataatatataaattgtagtagtggattacttatgatccattgctattagcattaacatccaactttttattttcattcttactcctccaagtagattgaataataacaagatcagcttaacgctgattatctatctttgaaagaacctatgcacttcccagcataggttttttcttttgcaataaaaacaaaaaaaaggttcctttcacatttggatacctcttttaattgtctgttcatttatccccaatggataaagtctaatgcatttttatcttgagtatatctagcataaactgaatttcttaattgattccagatcttgctttgaaaatcatttaacttaaattcatttagtgccatcgaattttcaactagactaacaacattaaatagttcggaagtcaaagcaactgcatgatattttcctgtttttaaattagtaattgttttgtttatttgctcaataacttgaattttctcaggtgacttattatcagctaaacttagtttaaatgcttcaagtaagctgatatattcttggatactcatttaattaccaaacaccaaattgattaattaatttaaatattatttcgtttttttgcaaatttttatccgttggatgcaaaaataaattccatgcttcagattgttttttagaaaaacgcaatcctctaaaagcaagagcatcattgatataactcatcgtttttccgactcgaatagataaagttattccctcatactttttattttgtaaatcaaataatgtttcatcaatgacttgatatagttcagtaaaattagtgaatgtattcaaatcaccatatggttcatgttttagttgatattctaagtttttaagtaatacaattgcttgtttaacttctgattccatactatcttggccatcctctaccaccactaataaatcccgtagcaacactattagccatattattaatagtgctacttactacaccgccccagttaactctacatttaccattttttagtgtagctggtccatacgagtagccctttctgcattccacattagatccccacggcataggatcataccagccaggagtagcagcagaagccgtattactactaaagtataaggcagctcctgtcataacaggaataaatgctgttgctaagaataatttaccctttttcatgatgtttacctccaagtttagaaaaaaatttttatttttttggaaagcgccttcatctaattaaattttatcataccaattataaatttcaattatttttccaaatatatcttagtattcatacagctaatgcataagaagtttacgtgttaagatcacattttaatgttagtggtataccaattttatatttttcaaaaaaattgtataaagtatgcttccataatacgattatcttacagaaaatcatttctaaatttatcgaaagatccagaaggtgaaaaagatggtttctaaagatgaaattattacaataatgtctgagttagttaactcacttaataatacaaatcctcattcagaatttactaacttccttacagatagtctaaacacaattaaatctagcaatggtgttgctttcacaggtcaactgcaatatttttttaatcacgcccctgttgtaaagttttccgataatatcacatttacttcgcaagaagaaaaactatggaataaactcctctctctaaacgagctagaaaataatctttggggtgcaagtttataattcatttccaacttcttaatcaaatttaacttttttaataaaaaacgtcacaatttgttcacattttcattctaatatataaaccatagcaacggggaagacaaaaccccatcgctattagcattaacatccaactttttattttcattcttactcctccaagtagattgaatacatttatcagtctttgactgatcctatacttatatattttgaaatccgcgtctttcccagcgcggatttttttgtgggcttattttcgagactttcatataatgataatagaatacaaagtaataaattcaattaacttaggaaggattattatgttttcaccagtgattcagtctttgattgcagaaaaagcaggttcatttattattcctgcttctaggattgcatttgtggaagacgaaaacccactctaccatgcttttttagttcttactaaaatgaaatattcaaaaattccagttttggataaagagcaaaaagtagttggcttaatcagcttatcgatgattacagacacgatgctgacgcctgataatattgtgattgaacctctatcggacttaaaagttaaagatgtaatacagacaaaatttgaaacaattaactttgcccgcactaatcttgagacgcagctccatcttctagttgataatccttttattccagttgtaaatgacaataatatttttcagggattgctgactaggcgagaatggattaaggcctttaattatgtaactcattcaattgaggaaaaatacaacattactaagaaaactttacagaaagaaaacccaataacttaaattcaataagttaagttgtataatagtaatgttttagtattattgattaaattagttggagggaaagctaatgagaaatcaatggaaatttttcacaatccttgggattggtgttgttgcagcaatcttagacttcctatgtggagcacctaagattggtgggtggccaatttccggtatcttaattgatatcttcggaatttttatggctattaccatgcttcgagaaatgattgaaacccttgaatctggtcgttggggcgtagatatcttggcaatcatcgctgttgtttcaacaatgattgtcggcgattactgggctgcttggatgattttaatcatgttgactggtggtgaatcacttgaagattacgctacaagtcaagctgataaagaattacgctctttactaaaaaattctccaagaattgctgataagttagtcgacggtaaaattgtagaggttaaagttgatgagttaaaaattggcgatatcgttttaattaagcctggtagtcaggtgcctgtcgatggagaaattattaagggaaactctagttttgaccaatcttctttgacaggtgaatcagttcctgttgataaaaaagttggcgatgatttaatgtcaggatcaattaatggggatgcagctgtagaaatgaaagttactaaggctgctaaagattctgaatatcagtcaattgttgctttggttaaatcttctgaagctaaaccagctaaatttgttaaaatggctgatcgctacgctgtaccattcactattgtttctttaatcattggtattgctgctatgattacctcagctgtaactaatccagctcttggctggcaagcacactttttacgttttgctcaagttatggttgttgcctctccttgcccattgctaattgcggcaccagtagcaatggtttcaggaatgagctcaatgtcaagaagccacattattgttaaatctggtaccactcttgaaaagttatcccgtaccttaacttttgcttttgataaaactggaaccttaactgaaaatcaactagttattgatcaagttgttttaccagaaaatagttctatttcaaaagaagagttacaaagcttggcagctagcgttgaacaacaatcgagtcatgttattgctacttcattagttaaaagtaccaataaggatttaattaagccagttaccaacttaaaagaagctactgctaaaggagttagcggtgaagtagacggtaaattagttaaagttggtaagctttcttatgttgatccggatcaagaaaaaatcactgttcaatcaactgctgtctttgtttcaattgataataagttcgctggatatattactttccaagatcaaattagaaagaatacaccagaaacaattgctcgtttgcgtcgtcaaggtgtaaagcaaatcatgatgttaactggggaccgtagatctgtcgctgataaagttgccaaagaagctggaattaaagaaagcgaagttcatgcagacttacttccagctcaaaagattcaagccattagagatgttaaacctgacttaagaccggttgcaatggtgggtgacggtgttaatgatgcaccaagtttaatggctgctgatgttggtatcgctatgggtgctaaaggagcaactgcagctagtgaaagtgcggatgctgttattatggttaacgacatttctaaagttaatgatgctgttgctatctctaagcacacaatgaaagtagcacacgttgatattattacggctatttgtattgttatcttgattgaattaatcgccttcacaggtataattccagcattttggggagcaattttacaagaagtagttgatttaatcaccattttattagctcttcttgctaaaactaagccaactaatcctaaacaaacaggactagaaaaataataacttaatttgcaactaaccatatttttagctaaactaatttttagttaaatatttttattagtggttgggttttataaaaactttcaagatttgcttatttgggtcaataagtgcttgaaagtttttttattttgtcacaaagttatagaaagctagaagaaaatgcactttttaggagaattaattttaattctgctggctacaacgttattaggacaattattttcacgtcttaatatgccagcagttattggacaattattatcaggaattttactcggaccggcaattctaggctgggttaagccaaatgaaattgtctccctcttttcagagtttggagtaattctattaatgtttttagctggtttagagagtgatttagacttattaaagaagtattttaaattaagttttactgtcgctggcatcggggttgttttacctgtatttttcacggggatagccagttacttatttgggatgcagttcctcgaagcactattcatcggaattgtttttgccgctactagtgtttcaatttccgttgtagttttacaagaagctaaccaaatccatactcgtgctggtactgctatcttaggagcagcagttgttgatgatatcttagcagttattgttttaagtttatttactacttttagtcatgaaggtggaaaaagtggtttaacgaataactttttcctcaatttacttattgaagtaatatactttgttgccgtttgggttgtcttcaaattcattgcaccacattttatgaaactagctgaaaaagtggaagtcgattatgcagtagttataggctccctagttctagccctcttaatggcctgggcagcagattttgtaggcttaagtgctgttgttggagcattctttggtggtttagcaattagacaaactccacaatataaggaagtccaatcttctgttagtgcaattggttactccatttttatccctgttttctttgtaaatattggactatccatgacatttgctagctttatcaaagatatctggttcattattgttatgactatcctagccgtattatcgaaattctgggctggtaaatattcaagtgaattatttggttttaccaagaatgaaggaaatattgtcggagcagggatggtatcacgtggtgaagtagcgctgattgtagcacaaattggaattactcatcacttattcccagaagacatttattcaagtttgattttggtaattattattaccacagttctttcaccatttattttgaactactatattaagcgtgaagtaaagaagaactaataaaaacgaggtcatcatgacctcgtttttttgtatttaatttactttaatacttcctagagatgtattggcttctaatacattttcagtgttactgttattctcaaaagaatctccccgctttttgccaccaaccgtaattttacccaaagaagtatctaaatcatatccacttgcattacatttattaacctcaatgtttcccttagcggtatcaaaactgactccttttcgtgtctttaattctttaatagaaatatttccattggctaaatcaatatctccattcttagttgccaaataatcagcactgacattgccatttgcactctcaatatttaaatcagtcaactcttcttttggcatttcaattataattttagaatttaactgcttaagattaaacacatttacatgaacaccaactttagaaaatgaaatctttaaatttccgttctttactttaacgtcaggagcaattttttctaagccagaataactaacactatatttactactagttttaaaaattatatctcctgttggaatatctacacttaccttattaaatttattaaaagaataagcgtaatttactatttttttatttgtcctattaaacattactatccctccgcctacaattacggcagtaatgattataattaaaaatatttttttccaattcattaaatatagtcctctaaatctaatattttgtcgtatctatttaaatcatctttttcataatgatgaatcacttcaataaaagttaggtttgaatttaataagtactgatgaataagctcagacgtttttttatcaagagaagcattaatctcgtcaagtaataaaacaggacgagccatcaaaattgcccttgctaattcaatccgcgctagctgtccacccgacaatttatctgcttcttcacccaattgataattgagtcctttttctttaatgagatttttcaaatctaacttattgcaaattttctctaccttttcccaggaaatactttctcctaaagttagattaaacaacaaactatcagcaaaaatcactggtgcttgacttgcatatgaaaacaagcccgaaaagttacctgcatttgtctttttgccgtttagtttaatttcttttgcttgtccatattttccatataataaaaattgtaacaaggttgattttccggttccagacggtccaataatcgcaatcttctctcctgatttaatctctatattaaccccagtagctaactgctttccatccctctttaaagttaaattttctatactcaaatcctgcaaacgtactgttttgctacctttatgatctttttcattatttaaaaagtgatctacattctcaactatttttttagtagtagctagcttatttcgatcatctaaaatgtataaaattggatttacaaaagaattggcaagttgcacaatagcaaacaatgctcctaaagttgtttgtctttttacaactaaatatattccaaataagaatggcatcaaaaaagtaatgatatgtgcaataaagttgatccatgaattagtatcaagattcaataaattcattctgcttaattcttgttctaatcttgctacagtttgcttattcttcaatactgcttgcctttgaccaccatatagctttagagtttcaacaccagccaaaaaattctttgtttgattaacatatctactatttgccttagtccacttttcagaagattcttgaattggtttttgaaaaatattggaaacaaacatcggaacaaaagaaccaaataagaataaaagagtaattaaccaattaacagctagagcatatcctagagctaagatcaaagaaaaactttgcataataatttcaatctgcgcatcaaaacgattagtttctagcaatttaaaatcattagttagaaatcctaagctattattatttttatctttgtcttcttctaacataccaccaaaaatacgagttctaagataaatatttacctctttaataatagttgtttttaagcgattaaatgataaactcgcaactaatgtaacagttaaggcggttacaatcacgactaaaaactgtgtaatcttatcccagctcttattgctagcaatattagtcagagtttgaacaatgttggccataataatattttgaaaactggcaatcaaacctaagacaatcatcaagataaacttgaatttatttgaatacctaaatagcatttaattatctcccatcaattaaatttgttgataagagtatatgatgagataatacttaaaaataaatctcttgcagatctgcaagttaaatttcgaggtaaaaaatgtacggtcatgaatttaaagaattacgtttagaacaaggtattacacaaaaagaagcttgcaaaggtatttgttccgaatcaaaattatctcgctgggaaaatgatcaaattgaagttgcgttcagtacagcaatgaggttattgaacaggattcacattactagtcatgaatttatgggatggtcaaaattttcacctcaacctgaaacagacaaagaagtaactgaggcctggcacaaagaagagattcctttgattaaacatgttgctaaaaagcagctcgataaataccaccaatcaaaaaatccttttgatcttttatcaaccgtagctttatttaaccagctggtaattttagaaaatcataattatcttcccgaagttgatcaaattaaattagctaatattttttcgaaggtggtaatttggtcagaatattatttagcacttttcgggagttcaatctttcttttaactcccaaacaagtatatggaatttctaaactagttttaaaagatgttagccgaattactgaagctaatacaacctatgacttagaggtaatgcttggtgttctgggggacgctactattaaattaattctaagtaatgatattaaacatgctacttcactaattaaagagatcaaaaaaattgagcttccgcattatatgatgtttttcactctaacatttaattatttagacaagattgcaaattatgttaccacgaaaaatgaacaacctattttaaatttgatcaatacgatggttcaaataggttgcccgattcaagcagaaatatatttagatgtatttaaacaagttaaaaacaatttggatagaaaaacgaggtcatgatgacctcgttttttactattctacttaaaagtaacggtataagtaacatgcttcaattatgaagataattactaaatacccataccactcaaaacttacaactggattattaaattccaccatacacataaaactacaaattatagtgcctaataggcaatagataaagggaatttcaggctttacaatctttcgttttaccattacgcatagaagaatgccaattaaacacaaacctagaaaaatccaaatcataaaaaccacctatactttagtgatttgctccctcaacggccttaatatcgcccttaccatcacgttcaacaattgcactaagtgcagctgttaatcccttaacaatatcaccaagagccatcgatggagtattaggacgatttacaacttgttctggcaagaaaggaatatggataaagccagccttaatatttggaaattccttgtctctcatatattgaacttgatacataatgtgattacatacataagtaccagctgtatttgaaacactagctggcaaacctgcatccctaattgcttttgcttctgccttaattggcaattgtgtaaagtaggcagtttctccatcttcatgaattggttcacctagtggctgatagccttcattatcaggaatacggccatcattaatattaattgcaacacgttcaggagttaatccaaaacgaccaccagcttgcccaacatttaaaacatagtctggcttttctttttcaattgcctttttaacaacttcagctgacttattaaagacagtcggaatttccaatttaataatttcagctccattaatttcagctggtaatctctttaccgcttcaattgcaggattaattttatctccaccaaatggatcaaagcctgttactaaaattttcataattttatcctttcaataattaaaatgctaaaaagtacattaagccaatttgaacaattaacaagataacggcaatcggagcttgttgcttaataacacccatctgatctttcatctctaaaagcgctacgggtaaagtattaaagttagcagccattggagttactaaagttccacaataacctgaggtcattccgattgctgctacaactacaggattagcaccttgtgcaattacaaaaggaattccaattgctgcagtaattaccgcaaaagcagcaaaagcattacccataatataagtaaataaggccatcgcaatacagtatagcgctacgcctaagaagtgatttccagctgggaaaacatgactaatcatgtcggctgttaacttaccaacaccacaagtcgtaaaaacaaccccaagcatggctaatagttgtggtaaaacgccaggtgctcctacgcttctaaccattctctgggaatccttgaaaacttgctttgctggcgctttagtcaagataatggctaagactagtgaaacaactgcaccaataccaattcccacctgaccaccaagtggagtaaattgtgcaattataatagatgttaatgccaaaacaatgcttggtaaaaatacctttgctcctaaacgtttagcatcttcttgagcagttttaggatttacagttggcaatttaccaacctggatttgcttaaacaaagctaaaattccgattactaaaaccattgcaccggacactacggcaggaatcaaatctccaaaagcaaaaataattgctaaaaagaaccagaaaattgctgttccaattcttgctttattagttttgtcacgcaatgtttcaattccagcaattgccatacataaaccaattaatgcataaagaatggcaagtaaaaagttaatcgtattttgcatattattttccttcccatttagccatttgacggtcaaagtataggttataagcaaaaactaaaacgaaagtaataatcgcaataggaatcgtgttaacaacaattcctactggatcaaccttataaccaagtgatttcattgttgaagaaatcaaaagtacaccaccagatgctacaaacaagttttgggcaaaaaagttaccaaagttgtcaattgctgcactgcgtccctttattagatcaatctctgattcgcttagtttctttttatcttgatcttctgcagcagcaattaccatcggtgcaattaatggacgaacaaattgaacctgtccctgcaaagaaatcccaaatacaccagcaagttcacgaattaaaagatagatatttaaaatctttcccgcagttaattttttcagtttttttattgcattaaccgtatagtctcttaatccatgtgattctactagcccaatcattggcaaggttaggaaaaacaaacttaccattcgattttccacaaaactctttccaattacttccaacaatttaacaaaatccatcccagagaaaagtcctgttacaattgctgcaataactacaactgcagtcgtgtcccacttcaaaacaaagccgactacaattattaatattcctaacagctttaaatattccatactacctattccttaaataaaaaataaaaaaatactataaaaatattatacaaaatgcaataaaaaatacgaaagggaaaaaccattcgtatttcaatttctattcaaattagttaatcaacaaataagtagctgccccaccttactggttcttcaacagtaggtagcaataagaaaataactacaataatccagccaaatggaataataattaaccatagccaccaaccactatagttcgcatcatgtagtcttcttactgcataacccaaaagacctaattttatccaaactagtaagatgaataaaattaattcaattagccaagttaaaaatgtaatatgtgatacagcccacgtcacattatttggagtaacagagaaaattccactagtacataatgctagtattgaagctattccaattacaattgttaataagaactgaataacaaatgcaacccaaaaagcttttcgagtactacgcgctgcccaagtgaacggatagagaaataatcctttaaaaatttccccaactgatggatctggaatatcactttctggtgcatgatattcttgttcataataaggtttatcagacataaaatttacctcatactaatttctaattattttctgcttttgtaattagtttatcaaaattttgatcctgatgttttttagctaggtcaggtgtcttccagtaaacttgatccgttattttcccttggccactagctaaaataactaccggatgaccgtccaagattgtataaccataagacgtttggtgttcatctttagctgtccaaccaattaacgtaatataattgaccccttttaaagcttcagtattattaaagactttaacccaagtatgagtatcgttcagatagtcattagaaaattgttgatgcttttcaaaatattctttatctgggatatgaatctcgtattgatgatcttccgttgtgagcgtatgagcaccaaattcaatttctcttaattgattatcatctttactatgtgtacgacgattattatccatactgtaccactcaccctgcagttttgcggggacagcatataggcctttatctccagcaatctttttagtttttactcgctgtctttctttcgtctactactttgacatttttaatgatcttatttactttattaccgtcgttatgattgttgaggtacttaatcatcattttaatatcagatgaaccaacttctttatttttgtgatagaagaaaatagttgggtcattcttggtgtagtagaaatatttgtctccattaactgtggcaatctcatatgcaacatcactgccattttgcatatatgaaaaatctttccgattatgaaggcgtacagtcacagtattattttgagcttgcttaaaagtcttcttccaaatatttggatatttttcaccagcatatgcaattgtaattgccgtttgttttttagtattcatattagttgctgtaagcttactactcttcttaactgttgttgtcttctcagttgatgaactagaactattattttgtgaattactacatgcggttaacatcgtacaacttaacaaaccaattaagccaattgaaactaattttttcatcatcgatacctccaaaataagttacctctcattgtctattaaaacactctgttatttatttcccaagcaatatcttcctaattattagactttgtttttcttgttttttatactaaaaatatggaacgagaaaagaggcaatcaaatgctaaataacatccataatttctttaatgcctttggggcaagtgtcattgtccctattatgatttttatcatttctttgtttttaaaggtaaaaccaaagaaagcaatgatgtgtgcattttatgctggtgtaggtctaactggtttttcttggattattaatgaatttactccagtagttactaaaatagtccgtcaaatggttaataataccggcataaagctaccagtcgttgatatcggttggcaagctggagcattagcgagttttagcgcaccaattggattaactttttttgtattcggactagtggctgaatttgttttatttgctattggaattacaaaagtttttatgccgtcaaatctttggaacaactttggtttcatgatttggggaactcttgctttttatgtaacacataattggtggatttctttaggcttatctttttttatgcttctctatacattactgctggccgaaattcaggcagatcgttggtctacgtattataagattgacaataccactgtctgtgcacttcaaaatattgttcaaactattccagccattttgttagatccactttggaatttacttggttttaataaagctaatttgactccaactgcatttaaaaataaatttggtgtttttggtgaaccaacgactttaggagccatcttagggcttttaattggaatattaggtaatattaaaaatttagccacagtagcagcatggggacaaatttttcaattctctattcagctttcagctgtcatgacgattttccctttagttacaaaagtctttagtaaagcattcattcctttagctaaacaaattaaccaagaacgtaaacaaaataaaaatacaaaatcaggaattgacttaatacaagatagtaaacgttggtttttagcagttgatgatggtgtcggttacggagaaccagctacaattatttcaggaattattttaattccaatcatggtagtcattgcttttgttttaccgggaaataaaactttacctgttgttgatttaattgctctcccttacatggttgaatcaattgtcgctattactaacggtaatattctcaaagtcattgcaaatggagttatttggtttagtttagggctttatgcttcaagctggttaggttctatttacacaaatacgatttctcactacggagctgctattccagcaggcatcgttttagtcactagctttaacttaatggctcaccccttgaatgcagcagtgtttgccgccttcatctcaaaaaatcctttttggattagtttgtgcattattatttacttagtactgctcattgtattaagaaaatatcgtccacagatttggacctacttaaataaaatggctgctaagaacgtgcaagcaacatcaagccttaaagcctctaccaaagagtgaatttgttacaataaaaaatgaaagaactaattaaaaggacgtgaagtttaatgtcaaaatttaattggaaaaatgtattagtagctggaactgctgctggtgttatctcgggattagttaaattgggctgggaaaacattctccctccaagaacaccagaaagaaataagactaatcctccacaaaaattactagagcaaatgggtgttccagcccacttaactcatgcaacttatacttattcaggagaaaaactaccttgggttagttatcttgttcactttggtttttcaatttcttttgctactgcctatgcggctcttcttgaaaagaaagttaagtggttaacaatagatcagggcgttccatttggcttaggagtttggatcgcttttcacctagtaattatgccattaatgaaaactgtcccttctccaaagaaccaaccaatggaagaacatatttctgaggctttaggacatatagcatggatgtggactaataacgaaattgctgaaattgttttacagcaattaggacaaagaaaaaaagagcattaatgctctttttattttgctataaaattgacaggatattgtttaacatatgagtcaaaatcgaatatcttacatcttttgtagtgacgtacgtccaagctaggatcattcccattacccaatataaataaataaatttactaaacatcggatcatgtccataagcaaaaataaaaccacttactacaattccaacccatttattaaatacattttctactgggaaaaatgtgttgaaaaatagcgctctaaagataaattcctcacagattggtgccactatcactaataaaacattgaacattggcgaggcaacttttctaattgcatctagttcttcttgattctttgaaattgtattaccaccaaataatcgcacaaaggctatttggaagattactaaagtaaagaaagccgctacagcaataataattctttttgtatcccagtgaggcttcgcattgaaaaaccaatcattttcttgtttaagttctcgtttataaatccaatacatccaataaattactgcaacagttaaaactgccaaaataaccgcaaacaataggttaactttcttttgtgcataacctaattgcaaaattgtataaaatacaaaagcaatgatcactgttgctagatttcctaaaaagcgtaaaaaagtcttcatccgaacacttcctctaattgaaattatttatttcttttcattataattgtttattaaaaagacataaggacatttaatcatgcaatcacaactcatgcaatctctgcatcaattttttaactttattgttcataatcaagtaacgattacctctttgattatgttcgtattttttattttatttttgctttcttggctgattgaaccacgtcgtttaatcaatggccttattttcacaatatttgggattagttttttagtatggtctgctattttaattatttctcaacacaatcctttactaactacctcattttctttccttgctttggctatcttatttggaatctttttcttagtaaccttttcttggattttctttctctggaatgcctattttgtctggaaatatgaaagccattctctgccaaatcttttaactttgattattggtttatttttagtaggaatatggactttaaatagattaggtgtatttcaccgcctaccggactggcttcattctctagttgctggagcaactttgattgccttttatcttctatttgtaatgtataactttttactcaatttagttctgtatcaaattactcctcgtcgctacaagcaagattacctaattgttctcggcgcaggattaattgatggaaagaaagtatcacgcctgttaggtgcacgaatcgaccgagctattgctttttctaataaacaatatgataaaggacataaacgtcccaaactaattatgtcaggtggacaaggaaaagacgaggatctctctgaagcagccgcaatgaaagattacgctgttaaacatggctacgatcctaacttgattttattagaagataaatcaactaatacctaccaaaatatgctctactctaaaaaagtagctactagtgattggggaaatccaaactttaaagctaagttttttactaataactatcatctttttagagcaggcctttatgcaaaaatggctcatttaaaggccaatggtgtcggagcaactacacgtttttattttttacctaatgctacaattcgtgaatttgctggggtctttattatgcataagaaacgccattttgttatcattggtttaattgcaattttatttataatccaagcaatatttgcagtattaggctggggcaaatatataattgcttagaaaggaaaaaatatgctacaactcttacacttaaaaaagacctatcacgtaggtgacaccgtcacacatgcattagatgacgttacgattaattttcgtaacagtgaattcgttgctatcttaggtcctagtgggtctggtaagacgactcttttaaacgtaattggtggattagatcattacgattctggagacattatcatcaatggtaagtcgacgaaaaatttctctcaaactgactgggatgcttaccgcaataattctgtcggctttatttttcaaagttataatcttatttctcacctttctattattgaaaatgtagagcttggtatgacgctctcaggcgtaagcagtaatgaacgccacgagaaggcaattgcggcgctaaagcgtgttgggctaggcgatcatttaaagaagcgtcctaatcaactatccggaggacaaatgcaacgagtagctattgcccgggcaatagctaatgatcctgatattcttctatgtgacgagccaacaggagctttagatactaaaaccagtgaaagtattatggagctaatcaaggaactcagccacgataaattagtcatcatggttacacataatcctgaactggctgaagaatatgcaagtagaattgtccatttccaggatggaaaaattcttagtgattcaaatgcctttgagcctaaaaaagaagtaaaggatacttttaaactcaaaaagacaaaaatgtcttactggaatgctctaaaacttagttttactaacattatgactaagaaaggtagaacttttttaactgcctttgcttcaagtatcggaattattggtattgctattgttttagctttgtcacatggttttcaaaaacaaattaatgaaacgcaaagtaaaacactagctaaatttccaatttctatttctcaaacggcaacagatatgaacgccgctacaagccgaactgaatctgacaaaaatgtcaaaaataagggatatctcgttgccgcaaaaccagacaatgagaaaaatacgcatgaaaataagattactcagtcttatatcaattatgttaagaaaattaatccttcatatgctaacaacatctcctttattcgaggaacccagcttaatcttttaactaatgataatggcaaaattaagcatgtagaattttctaatgttaacaactctggttctgctattgctagtgctcaacttcaaggaatgaatagtgtagggattaacacaagtgtctttcctaaaacacttgattcaaagcaaggaacttttttaaaggataattaccaactacttgctggttcctggcctaagtcaaataatgaagtagttcttgttttaaataataaaaatcaagctaatattaacgcacttaagaatttaggtatttcaattaaagatggtcaaaaaattgatctaaacaaacttgtcggccgtacttttaaggtgattagtaacaacaattactatcaagaattgcctactggaaattttgttccacaaaaagcttctaaatcaatgtatgattctagcaacttaaccttaaagttaagtgccgttattcggggtaaaaataatagtcaaatggctctgctagataacggaattgcttacagcgatggcttaactcaagaaattattaagcaaaatgaaaattcgaatattgttaaggcacaaaagaatagtactaccaatgtaatgactaatcagccaatgaaccaaactcaaaaagagcaatttattgcatctcttggtggttctagcatccctagcggtattcttatctatccaaattcatttaagtctaaagataaagttctcgattacttagacaaatacaataaaggtaaagctaaaaaaagatcaggttatctacactgatatgtcaggtactgttactaagttaactggtggtctgcttgacggaattactgacgttttagttgcttttgctgctatttctttagttacttccatgattatgattggtattttaacttatacttctgttttagagcgtacaaaggaaattggtgtgctaaaggctttaggtgctagaaaacgggatattacccgtgtctttgatgctgaaacctttattctcggcctcttttctggtattttaggtatcttaattgcttacttatgcactttcccaatcaatgcagtattatacgcaattactaatatgagtaacgttgcgcaactcgaccctatgcaagccttaattttagtaattattagtactgttttaacaatgcttggtggtcatataccagctcgaatggctgctaaaaaggacgccgcaattgctttaagaagtgaataagtctataaggatttcaacattgaaatccttatttttttgctctaaacttacctaagaaaaaagttatgaacttattcttatattttattgaaaacggcatcaataaagtatatgcttaaggtaacatatgttatatatgtggaaatagaaataggtgaatgaaaatgttatcgggtgtaacaatgttagatcttgcccgcttccaattcgcaatgactacagtcttccacttcttctttgttcccttctccattgggatgggattcattgtatcaatcatggaaacactctacgtcgttaaaaaggacgaagtatataaaaagatggctcaattctggggaaaaatttatctattgagctttgctgtcggggtagttacaggaattattcaggaatttcaattcggaatgaactggtccgactactctcgttttatgggtgatatttttggtgctccattggccattgaagctttgttagctttctttatggaatctaccttcattggtttatggatgtttacatggaacaagtttaagccagcattgcactgtgccttagtttggatttcttttatcggttcaatgctaagtgcaatctggattttaactgctaatgcctttatgcaacatccagttggctatgtcattaaaaatggtaaggcacaaatggctagtttttgggctttaattgccaatgaacagctttgggctagtttcccacacgtagtaatcggtgctattgttacagcttcatttgtagtaattgggatggctgcttttggcttacttagaaaacgggacgttaacttccacaaaaagtccatgcgtattgctctttgggttgccttatttgcctcaattgctgaaattggtgctggtgactatcaaactcaagttgaaattcacgaacaaccaatgaagtttgcagcaactgaaggtgtttatgaaacaacaggcgatcacgctccatgggatatagttgctaatttaaatactaaagaacataaaaatgaaggtgcaatttctattcctgatgttctaaccattcttacttatcacagtactagtggttccattaaaggaatgaatcaaatcaataaagaattgcatgcaaaatatgataaaaagtttggcaaagacatgagctattatgttccggttaagaccttattctatagctttagaatcatggccggttttggtgcattatttgccttgcttgcaattttaggcttaatttggactcgtccaaagaagaatacaattgaaaacaagcgctggttcttatggattttaggtatttcaaccttccttccatttattgctaatacttgtggttggttcattacagaacttggtcgttttccatggactgtctatggcctatttacaattgcagattcaatttctgcaagtacaaccactggtgagctctggttcacaaatattatgtacttcctaatcttctcaactcttggcggagtaatgatctattactgtaaacgtcaacttgatatgggtgtagctggtgcacttgaaaggggtgcatactaatgatcgatggaattgattttttacagttgctttggttcctattaattggccttctgttcatgatcttctactttactgaaggttttgactatggtgtaggaatggcaacacaatttttagcaaaaaatgatcaagaaaaacatgtaatgatggaaaccattggaccacactgggatggaaatgaagtatggcttatcacagctggcggtgccatgtttgcgtcattctctgattggtatgcaagtctatttagtggatattacatcttactattctttaccttatttgccctaattatcagaggagtatcctttgaattttctgctcatgccgaaactgaacatggatttagaatttggactagtgccctattttggggtagtttattagctccatttttccttacaatgatgttcggtagcctaattcaaggtgttccaatcgatgctcaaggaaatatgagtttaagtttttggaatattgttaacccattatcagtagttgcaggagtagcaggagtgctcctttgcttaattcatggaattaacttcttaagattaagaattgatgatccagaattaagtaagcgtgctgctaacttaaacgagaagctctatcttgtagcttatttaggagaaattgtctttgctttattgattttcttccaaactgatttctttaagttaagaccaatctcttcaacaattatcactttacttattgttgttctaactgcttggtcagatattgccttaattaaaaataagcaagcagcagcctttgtaacgagtggattaactttagtagctgttgttgggcttttattcaatggactcttccctcgcgtattaatcgctactgatccagcacactcacttttaattaaaaatgcagccaactctaaactaacacttgaggtaatgacaattgttgctctaatccttttgccaatcgctttagcttatatcatctggtcatatgtagtctttagacaccggattaaggtaaatcaaaacgcctaatctagaacaggaatgaaaatgattgataaacgactttttaaattaccaaaagccaaaatcatgctcgcaatgcttgcaggactaatgttcttgcaagcatttgctattttaggacaaggtattttccttgctcgagcaattgtcggctcttggaaacgacagtcttttgctaatattgcagaagacgttttaacttttttgatcttctatttattaagacagggaattaactggtttcaaaaatggtatatgaaccgttacgcaaatcagacaactgctctcttacgccagcaattacttaataaaacctatgatggtggaattgcattagtctccagaattggaacaggaaacttagtttctactctcttagatggaatggatgagatttccaactatctgtcgctaatttttccaaaattaattgccctagcaattgttccatgggtgattttaatttatatctttactctaaatgccctctctggatggattttactcttagtttttcctttactgatcttatttatgattattttaggaactgctgctcaaagtaaagctagtaaacagtatgctggatatattaaattgcaaaaccactttgttgatgctttacgtggcttaagcaccttaaaagttttgggtcttgctaaaaaatacggaaatattgtttataaaaatagtgaaaactaccgtaaaaagacaatgggtgtcttaagagtagcaatcctatccacttttacgctagacttctttaccacattatccattgcgatgattgccatgtttcttggaatcggattaattaacggaaatcttcttctttatccttcattagtgattttaattttatcaccagaatactttttaccaattcgtgattttggtaatgatttccatgcaactttaaatggtaaaaatgccttaggccaaatttttgatattctggcttttccaactactcctcaagaaaaccaattatctagtttcacgtggaacaaagatagcacctttatagctaataatgtttctttcaactatagtcatatcgatcaagatcattttagtgttaataaaaatgcaaaaatgagtgccgtagtaaaaaaagaacaagcaagtacagataagactcatacagctgatgagttacgtaatgttaatctaaatcttaccggatttcaaaaagttggcattattggcccaacaggtgctgggaaaacaacattaatgagaattttagctggctttcttactccccaccttaaagaagataattttacaattaatgggcaaaatcttgcccaattaaatcaaaagaattggcaaaatcaaattacatatattccacaagatcctttcatgttcgcaactagcattaaagaaaatctaactttttataatccaaatgctagtcaaaaagaaattgataccgcattaaaagcaactgatttgaataattttgttgctagtttaaaagatggtttaaacactagaatcggtgaaaatggacgcggcatttctggcggacaaaaacaacgcattgcattagcccgcgctttcttagcaaaagatcgaaagatattatttttcgacgaaccaactgctcacctagatattgagactgagtatgaattaaaggaaccgatgaagaaattaatggaaaatcatttggtcttctttacgacacaccgcttgcactggctaaatgacatggattggtgcctagtcattgaaaatggagaaattgtagaacaaggtacccctagtgacttagctaaaaacggaactttattcaaaaaacttactcagccattgaaagaagacctactatgatgaataaaaaattttcttggaaacatgaacattgggttaaaccttacctcgcaaaatataaatggaattttctcttagcgatttttcttggcatcactatgttcttttgtggtggtgcgcttatgttttatgcaggctatacaattgacaaagcggcgacacgtccagaaaacatcttaatgatttatgttccaatcgtcttaatgcgtgctgtcggaattggacgaccattatttagatatttagagcgcttagtctctcataattggattttacgtgtcacaagttctctaaggagaagacttttttatattgctgaaaaaaatacttcggcggtcggatcagcctttcaaacaggaagtattctttctctcctaactgatgatattggacacttacaaaatctttatttgagaaccatctttccagccattctaagttacctagtaggatttattgttataattttgattggtttattctcatggcccttagctggtattatcgcaattttattgattatggaacttattctcgttccattcttctcacttttaaaacaagctagtgtacgcagtaaggaaaaaaaagagaaggcacagctttatacagaatttactgatcaagttttaggtgctggcgactggaaaatttctggtcgcaaggatgcatttttcaatcaaactaaaaccactttaaagtctttagaaaagcatgaaaaaaaatccggcaagtttgattgggcacgtgattttgtccttgagtttatcttcggtttaatggctgttgctattctttatttcactaacaagaacctcacctataatcaagaagcagcaaattacgttggtgctgttgttttagccttgttccctctatctgatgctttcattcccgttggacaaggtattgaggaatggcacacctatagcgattccgtaaaacatttaaatgaattaacagtacctgaaaaccatttaccccatcaagaatatcttgacccagtttttgcaggaactttaaaagctactgatatttcattcacttatcctggagaagattatccaattattcaaaatttctctctcacattaaaaagaggtcaaaaagctgctctaattggaccatctggggctggaaaaagtactatcctacaattaattcttggagatttaaagccaaatacaggcactgtcactttggataagattaatgttttgtccttacaaaaagagcgttcaaaattattctctgtgctgaaccaggaaccatttttattcaacactactatctatgaaaatcttaaaatggctaatccagatgccactgctgaccaaatgatggaaattttagaaaaagtacagctagctgatttcattaattccctccctaaaaaactgaatacagaagtcgcagaagctggcgcacgtttttctggcggtcaaaaggaacgtttagcattagcacgtgtacttttacaagatacccccattgtcctcttagatgaaccaacagtgggtctagatccgctcacagaacaaaaattattaaatttagtatttgatgttttaaagaaaaagacagtagtttgggtaactcaccacttacaaggtgtaaaatatatgaacgaagttctcttctttaaagatggaaaagtgaccatgcagggcaatccttacgaactatttgaacacaatgagcattttcatcaactttatttaatggatcaaggactaatttaaaaatagaaagaagtttattatgtctgctgaagcaaagcaaggctactatgaattagttgaaccacgtaccctatttaactccataattcctgtcctattaggaatcatgtacacagaatataattttcagttgtttagaatttttccaacaattgaaatgtgtattgccacaattgttctacaaattttcatgaatgtgaatgatggttattgggattataaacgtgaaaaagctgctaaaactggcgatcataaaaagaatccgattgggaagtaccatcttaaccccaaacatgttttagttcttatttggatcctatttatcatttcagctacgtgtgcttttatgattggttttcaaactaatttatatatttggattctaggaattatttgttacgcaatcgctatttcctattcaacaggatctcatacaatttctgccggaccttttggagaaatagctgcttgttttgcaatgggatttggaatttttctaattatggtctacattaatgtgtatccccatgtaccatttaactggaattttgtttggccaattatccttgctgccggcattcctgaaatttgtaacttcactttaatgcttggaaataatctgtgtgatcatgatgcagatatcgcaaatggaagacatactttagtttcttatattggaattaagggtggactttacttattcgtatttaactacttacttggattctttttaacaggttgggcaatttgggttggagtccttccttggagcgtcgctttaattttgatttgtattccaacaatctacaaaaacatgcgctttctttggaaaatacaaactaagccaaaatctttccctaaagtagttcaaaatacccaagttttatttgtgaccgaagccgtaggtttctttatcggtttgatgttaaatcttagaattaaatatccttttgatccagatgttaatcatctggattttttattgtttttaaattcgtactttcagtatgcaaaattattgattttactagttttatttaataaaacacgaacaatatttttgatatattacaaaaatatacatgttttctattgaattcacgctcatagtttgctatctttatatcgtcaacttcattaaatagtttctggaggaaaaaatgaagataaagaaatttttaatcggcgctgctatggttttacttgctgcatcaactgctgcatgttccaacaataagtctgcttctaaaacaagtgatggctatactcctaaagaattaaacgttcagtttgttcctagtgtccaagcttctaaacttgaagctaaagctaagccattacaaggcttgcttgaaaagcaattgcatatgcctgttcatgtaactgtttcaactgataactcagctttagttgaagcaatggcatcaaagaaagttgatgtcggtttcttaccacctgatgcttatgtcttagcccacaaacgtggtgttgctgacgttttgctccaagcacaacgctatggctatgacgaaccaagcggtaagcaaaatcacaaattaatggatagctaccgttcaatgatcgtagttaaaaagggctctaagatcaaatcttggaaagatctaaaaggtaagacaattgccgttcaagatccaacctctacttctggttacgttcttccaattgcggaacttcacaagaaaggtttaaatgtaccaaaagattgtaaattagttcaagttaagggccacgatcaagctgttttatcagtttataacggtgatgccgatgctgcctttgtcttctctgacgctcgtcctcttgctgctaaagatgcacctgctgtaatgaaggatgttgttccaatttactttactaaatacattccaaacgatactgttgctgttagaagcggcatgtctaagtcatttagaaagaaacttgctactgcctttaaggatattgctaagaccaagaagggtaagaagatccttgaaaatatttaccaacactatggttatgtagattctaaagattctaacttcaatattgttcgtgaatacgaagctgaagctaaaaaggctgaaaaataaatttaatatttttaaaagaccaccctactttgacttgtaggatggtctttttctcgtttaaaattagaatagatttttaatcgaggttttcaaatgaaactaaataaaaaatttaatctattattgatcacaagtgctatctttttaatagcaagtgcttgtagcaagcctaatcatgaggaaacaataaataaaaagacagacaatcatatcgctctgatatctgacattaacggcattaaagataattctttaaatcaatctgtctggaatggtttaaaagattatggtactaaaaatgatcttccagaaggaaacaaaggctataactattttgtacctaaagatccgaaaaactatcaaaccactatcaatgaagcgttagataaaaatttctcaactattattggtgttggctatactcttaagccaaatattattaaagcagctaaaaataatccgaaaaaaaattttgttgttattgatgcccatactccaaaactaaaaaatttaaccggtatctcctttaagaatcaagaaggagcatatttagctggtgtagcagctgcttacacgactaaaagtcaaatagttggtttagtcttaggtcaaaatagtaaagaaatggcctcattcaaagcaggttttattcaaggcgtaagaacaacaaatcgtaaacttcataaacatattaaagtagtaagccagacagttggaaacttttcggatgctaataaagcacacgatattgcccaggaaatgtacaataaaaaagctgacatcatttttcaagcagcaggtaaaagtggacaaggtgtattcaaagcagctcaggaaatcaatcaagctcgacctgtagggcaaaaagtatgggttataggatctgatgaagatcaatcaaaattgggcgactaccttgcaaaaggcggacaaccatctaatttcactcttacttcagttatcaaaagtgccgatcttgctgttgaagatattgctacccaaactgctagtgggaaattcccaggtggtaaaactctgaagtatggtcttaaaaacaaaggtatttctttagttcaagggaatttatcctatcatacctggattaaagttcaaaaagctaagcaaaaaatcattgacgggaagattaaggttgatacagattaatagattgaaaaaagagaggtagttatttacctctctttttatttttatgaattaaagtcgtcttattagagcgttttaagttttcaaacaccttatctgaacaccgtgaaatataggcaaatactaaaacatctactacaaagagttgacttatcatcgatgtagtagcaccagacctaattttgggctccccaatatcttgggtaagtaatacaagatcagcttttttagctattgcagttctaggctgtgctgttagtaacacagtttttataccaactgatttccccacttctaaaagatcactaatttcagtcgtcattccctgattactgattaagattaaaatatcattaggggtaaagtttccaatttctgtagctgcaatatgaaaatcagtagtataggtgatagcttttcctaaacgaagaaatttctggtataggtcattagctactagaccggatgctccaacaccatatgctaaaatccgtgaagcctgattaatttcttttactagtttagaaattgttttttcatcgattccacttttagttatgtctatcactgacttaaaccttgtggccattttatcctttattgatgaaacatcttctccaatatctatttcatcatattcagcaggttctttgggtaactgtagtgcagctagttctaattttaattcactaaatccatcaaccccaatttcttggcagaatcgaacaatcgttgctgtactaataccagtatctttagataatttttgaatagaagactttataactgttttaatgttattacttatgtactctgctaaaaattgttctttttttggcatctgagccttcttagaatgaatgatatttaaaatatctgccatttttactccttcatggtacgaagtaagataaattcctggctaggctttatcaaattaatcaaaggtatatctttttctataatttttcctactatatttactttttcactagctggtaaatttaccttaagtatttgaatttctcccatataccgttggtacttatcattattgattgtaatatctccaatatatcttttgccagtattatttttcttaattaccggtaccggatgtaatctcgaatcttcacatctcactacatattcagctggatcaggccgctgattatgttttcctaatacataatcatataaatctttatctccattttcgcatttttttgtatgaagtaatatttgttttttatttttataagtatctatttgctttaacgaatcttcactaattcccccatccccgacataaactaaatctactcccatattttgtaattctaaaatactagctaacggactataataccgctgcttttcaagagttggcagtccctcgtataaaggacctcttaaattttcatccccagcaaaaaatgcctgagtagtaaagccatattttttaaacatacgaacttgctgctctaaaaactgctgactaattcctgtatcaggagaagggtaaaaattgaaccatgcttgcacgttttctctttttacatttaacaaaagcaattcttttaactcttcttcactaaaagtactagcatttatcccaatttctattaagttagacaactcagcaatttttttaattggcaatttatcatctattcgcaaaccagttataccggctttcttcaagttagggattgtatccattgatatttttaattttttcaaactactttgatcaatatcaaccattacactaagattctgttcttttgctatttttcctaattcttgtagattttgtttatagctagttatatcttcttcgggaatatgaatcgacgtaaagattccttcaaagccattatccttcattttcctaatatattctcgagtctcagcatcaatttttttatttaaatatacagaaaagcctaacatttattcactctttccaaaagaaggccaaaaagcatattactttttgacctccttctttaataattattaactaccgaactaatattaccgttacattctttcaaaatatccattgctttttctttatcaacacctgttttcaacatagtaatagcaactgcaacgttcatatctgctttttctaatgtatcgcttgctactgactctgaaacacctgtcgcaacttctataattctacatgctcgatctactagcttagaatttgttggcataacatctaccattacgttttcataaaccttaccttgtttgatcataacgcctgttgatatcatattcagaatcattttttgagctgtaccagccttcattcttgttgacccagttattacttccggacctactacagcttcaattgctatatcagcatattttccaatttctgatttttttacacatgctattgaaatagtaagagcttttacctgatttgcatatttcaaacatcctattacataaggtgtacgtccactagctgcaagcccaattacaatatctttctcatttaatttaaggtcctttaaatctttctctcctagttgtagatcgtcctcggcaccttctacagcgcggaacatagcactttggccaccggcaattaatccaatcgctctttcaggattgattctataagtgggaactaattcaactgcatctaatattcctaatcttccgctagttcctgctccaacataaattaatctcccaccctctctatatctttttgatgcatattcaatggctttggcaatttctttatcttgagtaccaactgcatctgcgatttttttatcttcttggtttattattttaactatttcaagaggagtggcgctatcaatgtgtagagactttggatttcgttgttccgttgttaaatctttaatattcatttttatcctcacttactagttatctttaatacgggcatatcggccttaacggtacctgtagcaattagcttaaaattagaaacatcatctatgttagtaatagtcataattacgattggatcctttccagcttcttttatttttccaatatccatttgtgcaacaggttgtccggcttttactatgtcattttcttttactttgatatcaaaaggacggccctttagttctacagtatccaaacccatatgcaataagatctccaaatttcctttagttgattttaaagttaaggcatgttttgtagacattacactaactacttttccatcaacaggagcaacaattttcccatcttttggaataatagcaaatccttctccaagcattttttgtgaaaatacttggtcttcaacttcatctaactcttcaatttgtccatctactggagcaacaatttcttgtgttgttaatttagcgttatcttttacctcattttcacctgaagtagacatattcaaattatatgcttgctcctcagcttctcttcgttctttaacttcagcatcagcctcatctgcaggaagcatagcctctttcggaacaccccagaagtaagtagcaataaaaccaccaacataagaagctaacaaacctaatatataagcccaccacatgttatgagcaattaatggaatcaaggctacacctgaaggcccgatagctattgagccaacttgaccaaaagcagcaactacagcaccaccaataccaccaccaacacaagcagtaataaatggacgtcctaatggtaatgtaacaccatagattaatggctctccgacgcctaagataccaactggtaaggcacctttaatcatatttactaattgtttatttttacgacactttacccataaagcaattgcagctcctacttgaccacctccggccatagctaagatagggagaagaggagtaaatccaagtttttgaatcatttctagatggataggggttaaaatttgatgtaaacctagcattaccataggaaggaagaataatcctaaaataaatcctgagattggtccaccaacttttaacacccaattaattccacctacaagagaattagaaaaccatcctgccaagggcataattacaaaaattgtaaataatcccattattagtattgttaaaaatggtgtaaaaataatatctacagagtcagcaatatgcttatggaaaaatttttcaacataagataatagccaaacgcctaataggacaccgataataccaccctgaccagcagctagaggttttccatcaaaaatattaggaatgcttactggagcaacaatcccaggtaagtaaacaataccaccaatgataccacccaagcctggagtagccccaaattcttttgctgtattaatacctacataaatattcaaatatgcaaataaagcactagaaatcattgctaatactgttacgccaagattccaggacatcggcaatactttagcagttaacaagtttctcagaattcccgcaacaccggaaattagtccggcacctacaaatgcaggtattaatggtacaaaaattgccgaaatatgttgaagagctgaccgccaccaggtcttttttaaagaagctttgtgagctgcatgcacttcagctgctttcttttcaacttcacttttattagattgatatgaatttgtttcaggaaaagtttctccttcctttacgccagcctcattattcattatcgtggcaaccttagtattaacgcctggtcctaaaacaatttccagtgtatcagcttcaactactcctaatacaccatttatctttttcaatttctccatatttactttagacatatctctgattttaattctgagtcttgtcatacaatggatcaatgattcaacattatttataccaccaatttcttggtagatttcatcgcttagaatttgatacttatcctttgacatgatgaatctccttatataaatgtaaaaatgtttcatttaaatatgtaaaaatttatcacagtaattaatgtaatcgctttctacatctaaaatattagatcctattagtatttatgtcaataatttatccttaataaaccaaatatatttaatctatagttttatgtaaaaataaaatattgttacatttattaaaaatgcttatttactaatcttaaagatattacccttcaagattactcctacttgctaactaaacgtaaggggcttataatacctaccattgtaatgtttaaatctacaaggagaggtgaattcatgggtccttttttcttattcgtttatttaattttgggtgggaccttaggaggtttgctatcaaccattgctagcatggcttcgctagcaacttacccaatacttttatcagttggaattccgcccgtatatgccaatacaaccaatgatgctgctttaatttggactggagttggttcaactgcatcatccctgaaagaattaaaaggacattggaaagaagtaattttctattcaatctttacaattgttggatcagctttaggatgtatgcttttaatacaatttcccgggaaaatattcgaaaaaattgttccgttttgtatcgctttttctggtctaatgattttattcagtggtgaaattcatctggaaaaagatggtaataaccgccttcttcagattatatctttactttgcttagtgattactggtatctatgcaggatatttcggagcagcaagtggcgttttaatgctcgttatcttgaacgccattagtgatgatgattttttgacagttaatgctatgaaaaatataattggggctctttcaaacttagttgccctaatcatctatatgtttactgcaaaaatttattgggattccgccattccattggctattggtgccttaattgggagttatttcggtcctcgaatcatgcggcacatttccgttaaagttattcgcttaggaattgccgttttagctcttattcaagcagcttactttgcttatactgcatataggtaaaacatttgtaatacgtaaaaagctctacctgcgtaaaggtagagctttttcagttacttttaaataattttctttcatttcagtttatatcatcgcaagcggcattttttcagtcggctgcggaaagtcattatcaattaattttatttcatcgggagtcaatttaatatccttagcagcaatattttctttcatgtgtttaacattgcctgcttttggaatagataaaatattaccctttctcaaagtccaagcaagcatcacttgatgcggcgttacatggtgagcgcgagcaacaatcttaagattattagtaattctgattgaatcacccttacctgaattaaatggagaatatccaataaagccaacgccgtgcttttcttgccaaggtaagacggcgtactctacccctcgctcagagagattatatagatcttcattagcaaagcagtcttttccgccaggaacgctaaataattcttctaaatcagccacatcaaaatttgacacaccccaatgacgaattagtccttctttttgtaattctttaagtccacgaaccgtttcagataaacgcttgtctccgcgccagtggagtaaatataaatctaaataatcagttcctagtctttttaaacttttttctaagctttgccgctctaattctggagaagcatgatatggataaaatttcgaaattaaaaagattttactccggtcatatcctctaattgcctcgccaattagcttttcactttttccttcaccatacatttccgcagtatcgattactttaattccatgatccaaaccatagcgaagggcagcaagttcatcttttttctttgaagcgtcttcgccgattccccaagttcccatacctaaacctgatagattactttcctgaaaactcttctccatctcttctcacctcacctaaattttaccgcagaaaaaaataaaattaaaaatgttagcggtttaatttgactagaccaattttatattttataatggactagaccaatgaatgaggaggtatatattatgaaaatcatcgtaactaaagataatattgaaggcggcactaaggcatttgaaattattaaaaagggaatggaagatggcgataaagttttaggtttagctactggctcttctccaattccactatatgacgatatgtgcgacagcgacttagacttctctgatatgactagtattaacttagatgaatactatggcttaaatccagataatgatcaaagttatcattacttcatgcaaaagcacttatttgataagaagccatttaagcattcttatattccaaacggaatggcaaaggatattgatgaagaagttgatcgttataacgacattattgctgctaatcctattgatatccaaatcctaggtatcggtagaaacggccatatcgcttttaacgaaccaggtactccatttggcagtttaactcataaagttcaattaactgagagcaccattaaggccaattcacgtttctttgataacgaagatgaagttcctcgtcaagccatttgtatgggaattaaatccattatgcaaagtaaaaagattgttttacttgcatttggcgaatcaaaacaagatgcagttaaagccttagttgaaggccctgttactgaagaggtaccagcatctatcttacaagatcacccagatgtaacagttatttgtgatgaagttgctgccgcaaaacttgatccaaaatatagaaattaatcctcattaatcagaccgtttacttgaacgaattaatctttttagattagttcgttttttatttggtagaattcttttacctttaatctacattttttcagatctactcttgactttttcacttaactcttttttcaaaaatagcttgcctacctaccagatattgaattacactattaaagcaaactatatattgtagaaagaacgtgatgacagttattgtattgagcgggcccattggagccggaaaatccagtttaaccagtcttcttgccgaacatttaggcactcaagccttttatgagggtgtagataacaatccaattttgccactttattataaagatatggctcactatacttttcttttaaacacttatcttttaaaccatcgtttggctcaaattaaccaagctattcgcgatcataacagcgtgtctgatcgttccatttatgaagatgccctatttttcaaaatgaatgttgatagtggtattgctgatcctacagaattcaagatttatgatagtttacttgagaatatgatggagcaagcacctggtaatccaagtaagaaaccagatcttttaatttacattcatgtttctcttgatactatgcttcaccgaattcaaaaacgtggtcgtaagtttgaacaattatcaaccgatccaagtttaaaagattactatgctcgccttttatcatattacgagccttggtacgaaaagtataatgcatcccctaagatgatgattgatggtgataaatacgactttgttgccaatgaagacgcaagaaggaaagttattaacgcaattgatcaaaaacttattgatatagggaatttaaactagttaacgaatagaaggaacgtgatgacagttattgtattaagcgggcccattggagccggaaaatccagtctaacaggtatcttatctaaatatttgggtactaatcccttttatgaaagtgtagatgacaatcctgttttgccattattctatgaaaaccctaaaaagtatgcctttttactgcaagtttatttcttaaatactcgttttcggagtattaagtcagccttaactgatgataataatgtacttgaccgttctatctacgaagatgctcttttcttccaaatgaatgcagatattgggcgtgctactccagaagaagtcgatacttactatgagctcttgcacaatatgatgagtgaactagatcggatgcctaagaagaatcctgatctcctggttcatatcgatgtctcatatgatacaatgctcaagagaattcaaaaacgtggtcgtaactatgaacaattgagttatgatccgactctagaagattactacaagcgtctacttcgttattacaaaccttggtatgagaagtatgactattcaccaaaaatgactattgatggtgataaacttgatttcatggcaagtgaagaagatcgtcaagaagtcctaaatcaaattgtggctaagctcaaagaaatgggtaaatttgaagacgactggaaacctaatttagttaaataaagcaaaactgcggtccaatatggatcgcagtttttattttttaatcctaacaatcaatgtcttgatgcaccacttacagcatcagctgcttcacctgttaactgattttccttagtaacaggatatggtttcatcacacttctgctcgttgaagaaatgccccagtcagcactgtaattaatatgatcaatcttagcatgtttaatatcttcaattgtcttacagccggttaattgcatatcaatcaataattccttatttaattgctcaataactgattgaacaccttgtgcaccaccaagtgctaagccatataagaatgggcggccaataccgactaagtctgcacctaatgctaatgctttaaagacatgagagccgcgacgaacgccgccatcaagaataattggaacacgatgatttgagcttcttactgccttagcaatttcaggtaaaacatcaatcgtcgcaggagcgccatctacttcacgtccgccatgattagaaactacgatcccatctgctccagccccaatagcaagcatagcatcttcagcacattcaactcctttaacaattacaggaacatcagcaatttcctttattttacgaatatcatctggtccaatattttgagccgatgaagcatacatttgtgcaacgctttgtccttcaccctttccaccgttccattcattaaagaaagccaacggtaccggataagtaaagttagttcgtaagttagcttcacgatagccactaactaaagcatctactgttaggaaaaatcccgtaaaacctgctttaactgattcttcaattaccatcttattaaagtcccagtttttgcttaaatatagttgcataaatctaggagaatcccctactgcactttgtacttcttgtacactcttatttgcataggtactcatcgcaaataaggccccagcagcttttgcaccttttgcagtatcaatttctgcttcagcgtttgcaataccgtggcatgcaattggacaaatcataaccggggtctttaacttcatccctaaaaactcagtattaagttcagggttttgcattccagtcaaagctcgaggaactatttgaaaatgattaaatgcttgagtgttatttcgccaagtccattcattttcagcaccactagctacatagtaataagcagcttctggcatcacatattttgcctcattttccagttcatctaagttaaccatatgtaacttttcttctcttgtactttgtggaaagcccttatagtaagttgtcatcgtacattcctccaaattttataacgcatgtttctttacactttaattttaagactatttttttaaatgagtaactaatagcccttacgaaataattcactatctcttataagatttactttcagaaagtttttacaacctttcatcgctaaaattcgcgtttacatttatttatgggaatgctacactataaaagttgcttatttaaagcttaaaaacgaacattatgtctggaggacaaaatgaattttataaaaaactactttcatttagaaaagttaggaactaatgttagaactgaatttattgctgggttaactacttttattagtatgtcatacattcttttcgttaaccctagcgttcttggcgctagcggaatgaataccggcgctgtctttaccgctactgctttagcagctgctcttggtacagcaatcatgggaattgttgccaactacccgatcggtgaagcacctgccttaggtattaacgcattctttgcttacacagtatgtattggcatgaaagtatcctgggaaactgctttagctagtgtttttgttgcatcaattatctttattttaattaccttatttaagctaagagaaaagattattgattcaattccttcagacttaaaatttgccatttcttctggtattggtttatttatcgcctttcttggattacaaaacggtggcttaatcgttgctaataaatcaactttagttggtttaggatcacttcataatccactcgtttggattaccatttttggtttaattgttacagtaatcttgatgatcttaggtgttccaggtgctatttttattggaatgattgccgcatcaatctttggaatttgtaccggtcaaattgccgttcctcataagtttatctccttagcaccaagcttagctccaacttttggccaagcaatcttccacgttaaagatattaactctttgcagatgtgggttgttgttttaactttcttacttgttacattctttgatactgccggtactttaatcggtcttgctcaacaagctggctttatgaaaaataataaaatgccacgtgtcggtaaagcattagctgctgactcaactgctatgatgtttggttcaatcttcggtacttcaccagttggtgcctttgttgaatcaagtgctggcattgctgttggtggtcgttctggtttaactgctgtctttgtagccattttcttcttgatttcaatgatttttagtccactacttggtgtctttactacacaagtaactgctcctgcgttaattatcgtcggagttttaatggcacaaaataccgcacatattcactggaacaagttagaaattgccgtacctgcatttttaatcttacttggtatgcctcttacttactcaatttccgacggtttggcattaggaatgattacttacccaatttgtatggtttctgcaaagcgtggtaaagaagttagcccaatgatgtgggtactgtttgtagtatttatcatcttcttatgggtattgaattttaaatagattgaaactcaagagaaaagctcgtgctgatgcacgggattttttggttaatcaaaaatttttctgtcaattttaaatattgttttactctctactgatttccaaacaataagattttttaccgcattttggacaagtcaattttctaaacttaggcgtatgcggggctaaattaaatgccaaaaatgatggaataaatacatctccgcaattaggacaaacatattcaacatggtcatagtaatatcgcgacaatcccaatgccatcataaaaataataactactagtgcaagaacttcaattacaaagctagttatctggtttagatgatataaataaaatgctatgccgatccctaatatttcaattattgacaaaagccctccaaaaactaacatcttatctcttaaagctgaaagtctattttcttttctcataatatctgtaatgccagagtgattggttaatacagcacgcgacaactttattttttgcaaatgttttatttgtgcttgtttcttacttatctcctcaattttccgctgattctcctggtattgttctttaagcaataactccactgactgattcccatgctcatcttgaatgagcatttttatctgcttcaatgaaaatcccaattcttttagaaaaagaattaattcaagttgtcttatctgatctttttcataaaaacgatagccattttcttcagtataagctggcctcactagatctttttcctcataaaaccttaaagtccgtgtactcacttgtaatttctttgctgcttctccgatggtatatctctctgacattactttcacctcccagctttaagatatcaattgacgtaaggttaaagtcaacttctaaattataaaatattctatttccttggaaatattgttcggcttttaaaccaattttcttatttttgtacctattattttatatttttttgatttaatcgaataattatagtttttattcttgaaatagttaatattttagatataattttatttgaagattcgcttttaaatgattaaatacataaattaatcatttaaaattatattttcctttaaaatccgaacattaccattcttggagggctacatgaattcaattggtaaatttttccatttaaatgaaaaccacacttcatttaaaactgagtttttagctggattaactacttttgtaagtatgtcttatattctttttgttaacccagctgttttaggagcaagtggcatgaacaagggagcactatttaccgctactgccttatctgccgctttcacttgtattgtaatgggagtaattgccaattatcctattgcctctgcaccaactttaggactgaatgcattctttacttatacagtctgcttagggatgcatgtaaaatggcagactgctttagctgccgttttcgttgcttcaattcttttcattttactaactgtatttaaagtacgtgaaatgattattgacgccattcctagtgatatcaaatatgctatttctgctggtattggtttatttattgccttcattggtcttcaaggtggtaaattaattagtaaaagtgattcaactttagttactgttggttccttaaataatccacttgtttggattacaatctttggtttagtagtaacgattttcttaatgattgccaaggttcctggtgcgatctttattggaatgattgttgcggcaatttttggtattataattggtcaaattccaatgccaaaagcatttatttcaggagttccaagcctttcaccaatttttggacaagctgtatttcatattagtgatatcaatacagttcaaatgtggattgtcgtctttacatttttactagtcactttctttgatactactggtactttaatcggtcttgttcaacaagctggccttatgaaagataacaaaatgccacgtgctggtgaagctttagccgctgactcatccggtatgttagtaggatctgttcttggtacttccccagttggtgcctttgttgaatcaagtgctggtattgcagtcggtggtagaactggtttaaccgctgtttgggttggtattttcttcttaatttctactatcttcaatccaatcttgagcgtcttcactactcaagtaactgctcctgctttgataattgttggagtattaatggctgaaaacttggcgcacgttcactggactgatcttgaaatcgcaattccatgtttcttaattgctcttggtatgccacttacctattccatttcagatggccttggctggggactaatcatttacccagtatctatgctagctgctaagagatttaaagaaatcacgccaatgatgtggatcctgttctttatttttgttatttacttcgttgttctgaatgttaaatagtatcgattagcttatatatattaaaacaagtagcttttaaggctatttgtttttttgatttcaaattggcatcttttgctaatcaattgacatcttatgctgtttgaacttatggcctttatttcctaagaaattctttctctaatttgcctatctccaaaatatctgctagaatacttaacaatcaagttatctatatatcgtcgaaataaggtcgacagtatctaccctgagccataaattcaggactataggtatcagacgtcataaattgctttaaaggacatcttttacccgtggctcttgggtaaactgtgtccttttttcatttttattttatgttggagaaatgatgcaatttttagacaaaatctttcatttagaggatgctcatactaatgtcaaacgtgaattaattgcagccttaaccacgtttgtttcattgtcatacatcctttttgttaaccctaatattttaagtgcagctggtattaataaaggagctgcctttaccgttactgctattgctaccgcaattggttgtttcttgatgggatttattgcgaattatcctattgccttagcaccaacacttggtagtgcagcctttttctcatataacgttgttatcggaatgcatatcaattggcaaactgccctagctagtgtgttagtagcttcaattttattcattttgattaccgttttaaagcttcgtgaaaaagttgttgatgcaattcctcaagatttaaaatatgcaatttctgctggtattggtttgttcattgcctttattggattgcaaaatggtaaattgattgtcgacaataaatcatctcttgtcggtcttggttcatttaacaatccagccgtttggatcacattatttggtttaatcttaactgtcatcttaatggcagctaaagtaccaggctcaattttcatcggaatgattgtaactgctattttcggaatgattattggtcaaattccaatgccacatggtattgtttcaggtgctccaagtattgctccaacctttggtcaagcagtttttcatttaaaagatatcaatacaccacaactatttatggttgttttaacattcttacttgttacattctttgatactgctggtaccttaattggtatgacacaacaagctggaatggttgataaaaacggtaaaattccacgaattgggaaagctttcttgtcagactcactagctatggttgaagggtctgtgttaggtaccgctccacttggtacctctgttgaatcaagtgccggtatcgcaatgggtggtagaactggtttaactgctattttcgttggtattctattcttaatctcaatgatcttcagtccacttttagcagtaatcccaaccactgtaacggctcctgctttaatcatagtcggagttctgatggcaggtaatcttaaatacatccattgggataactttgaaattgcctttccatctttcctagtagtagttggtatgccgttaacttactccatctctgatggtttagccttaggaatgatcgcttatccaattaccatgattgcttctaagcgctataaagaagtatctccaatgatgtacattttatttgtaatctttgttatcttcttcttaattactaatatgggctaattaataatcttttttcaagctagtaacgctatctcttaagatgcaagcattactagcttgtttttttgactcaattttcattaaattaaactgcgaggtgaaacaaaatggactttaacgaacaaataaaacgccttcgaaaagaaaataacttaactcaggaagagatggccaagaaactaaatgtaactagacagacaatttctaactgggaaaataatcgtaaccttccagattttgaaataattattttgattgcagaaacatttggtgtttcccttgatgaattaattttaggagataaaaagatgaataaaattgagcaaactttgatcaacgacggcaaaagaacacgtgcagcaaaatttaatatggtcactactatcatcgggagtgcattcattattttaggaattattttcttcttaatcagcggtgcctctgtttcttatattgatagtaatggttttttacacgaaaacttcttcttaattctattaggctatctttcattatttgtagggatagtgatcattattgcccggataataaattcgattcgtcttgcaattaaagaaagaaaaaacaattaaacttaaattttacgcgagtaatatgcgataattaggataaaaataacaatggagaattatttttatggcagtcaaacctattattcatgatgaactttctttaaaatttaagtctctaccagcaactaaacaagatttaggagcagccactgatttaaaggacactttactgtctaataaggatagagcagctggcctcgccgcaaatatgattggtgttcaaaaacgaattattgctttatttgttggaccactcccaattgtgatgcttaacccaattattgtggcccaagatgataaatatttagcttatgagggctgtctttctttaactggagaacgtccaaccgaaagatacaagaccatcacagttaaatatcaaaatgagaatttagaaactcggcaacaaagtttctctgattttactgctgaggtaattcaacatgaagttgatcattgtaatggaattttgatttaattaaaaatttttacgtataatatttttcccaaaaaaggtagagtactcgacttaaaaatcgaatactctaccttttttattttagaattgtcgattcgttgaaccacgttcaattttaattctaactatcaagtggattaaattatacagcaaggttaatgctaataaaattatccaaaaagcaataaatgcataaataattagtaaaatagctgggaaaatacctaaaaaagttgctactaaactatcagctaacttcagcttcttattaagaattccctctctaactaattgatatgacttaaatcctaaatagcctgaacctgtgattccagctagccttaacaagagatcaatatttataaaggcacaaattatgctaaaccctatataaaaactaccaattacaactataatatttcgatctatttttgtaattgcatggtcttcttctaatttttgttctatgtcaataaggcaataaatgattgcacatactgccactagtcgatatacccagcttacattttttaaggctaaaaatatcactacaatactcagaatgattcctattacgccgataatatgattcaactttctatttttaataattaagtctgggcgcatctactcaatcctttcttttttctatagttctcggttagttccgtcatgttcaaccttaattctgacaattaggtgaatcagattataggctaaagcaaaaatcaaaagaaatagccaaagaatgtctttaggagtaagtaatataagcacgattgcacttccgagtccaagacaaattgcgactatactctccccaaatttcagttttttattcttcaaatctttacgaaataccgcgttcgtcttaaagcctaaatatcctgcacttataatgccaaaagctagtaataaataatctaaattaatgaaagcaaaaacaatactagtcagctcataaactattccaaggataataaaaataatcttctgcgtcctattaattgccttactgtcttcaagcatctgttctacatcaatccagtagtagagaataactgctacgacaatgaaagtaagtagccaaccaatatttttcaatgtaaagaaaaccatcatcaaagcaatcaataagctgataatgccaaaatacttatcttgcttacgtcttttagctagttcaatccatcttttatcgtccatctactcaccttcttaaattatttgtctagattttactatgaaatgagtattttaacaataatttaattatatttttattaagcaagctaatctttattgttgacaagtgtaaactaaaagttatatgattacatttgtaaacgaaaggaatatataaatgaatgaaaagaatttatcttcaatttcagacagtgaatgggaagtaatgcgcattgtctggacattaggtgaaacaaatacaaaacaaattttaaacgagcttcaagctaaaaaagattggacagattctactatcaaaactttaattagacgtctcgttcaaaaaggctggttaaatgctaagcaagatggacgccggtatatctacacagctacggttaatcaaaccgaaatgatgtacaacgaagctaagaccttactaaatagaatgtgtgatatgcacaagggagaagtaattttgaaacttctagaagactcccccgtttctaaaggtgatttaatgaagatgaaaaaagagatcagtcaaaaagaaaaaacggcacttgaaatggttccctgcaattgcttaaaaacagggtctactatttgttaggaggaaacaagaatgaacgtaagtcagatcattgccttaatcgtcggggtaattttaatcggttttattatttggtggttctttggcaaacataaagaagctgccggtacgagcacaattgttaatgatgaacaaactgcaacaattgttgtaaatggtggctattcaccttcaacagtaattcttaaaaaaggtgtgcctgctcaagttaactttgacatgcgcgactcaacagcatgtttatcccatgttgttttcgaacaattaggagttaatgaggacttaaccaaacaaaaaattactactgtcaatattccgacagataaggccggaacctataactttgcttgcggaatggatatgttccacggaaaagttatcgttaaataaagaaaggatctattaaaatgagtattttttcaaaaaatcaaaccaaaaaagttgttgtcaatgcagaaaatcatggctataaaccagataccattacttttaagcaaggtaaacctgcccaattaaaatttattccatctgacaatatgggctgtatgaacgaagtagtttttaaagacttgaatatagatgacaaacttgatggtaaaaaagaagttattgtcaatatccctacagacaagcctgctacttataattggagttgcggaatggacatgtttcatgggaaggttgttgttaaataatgaagttatcaaacattaaaagattttggatatcttttatcctctctatcccaatgcttattcaaatgtttgcaatgccatttcattggatgatgccaggatataattggattgctcttatcacaaccacaatcattatggcaatctctgcacttccttactggaaaagtgctattgccgctttcaaaaagcatagtgctaatatgaataccttagtggctactggtacagctgttgcgtatttctacagtatctttgccatgatcactaatcgtccagtttactttgaaagtgccgcatttgttactgtattcgtcttattaggcgacgctatggaagaaaagatgcatgataacgcatctaatgccttaggtaaattaatgggtttacaagcaaaagatgcggaagttcaaagagatggtaaatttgtaaaaattccacttgatcaagttcaagttggcgacattattcgcgttaagccaggtgaaaaaattccagttgatggtgagattctagaaggtgttactacactggatgaatcaatggttaccggtgaaagtatgccggtagttaaaaaagttggtgacaccgttgtaggttcaactattaatagtaacggtacaatcactttcaaggctactaaagttggttctgacaccatgcttgctcaaattgttgatttagttaaaaaagctcaaactagtcatgctccaattcaaaacttaacggataaaatttctaatatttttgtccctgctgttatgattattgccattttaacttttatcatttggtactcattccttggagcaaccgctgttgaagcaatgctttttgcagttagtgtgatcgttattgcctgcccatgtgctttaggacttgctactccaaccgctttaatggttggtactgctcgtagcgctaaaatgggagttttgatcaagaacggtgaagttcttcaagaagttagtgacttaaatactgttgtctttgataaaacaggtactatcactgttggtaaacctgaagttactgatattgtcggtgacaaaaaacaagttttaagaattgctgcaagtcttgaagagtcgtctgaacacccgcttgctatagcgatagttaaaaaagcagattctgaaaaattacaaatcgaaaaagttagcgactttgaagcaattgaaggtaaaggcgttaaagctaattaccatgatcaaacagcttttgttggaagcaatcgattactagccgacgtcaacatttcccaggaaatgaaccagcaagctacaaaattacaagaagaagctaaaacagttgtttatgtcggcttaaatggtgaaattattggcttaattgctattcaagatattcctaaatcaagctctaaagaagctatcagtgaacttaagaaacgtggattaaagacagtaatgcttaccggtgataatgaaaaagttgctcaagccattgctaatgaagttggcattgaccaagttattgccggcgttttaccaaatgaaaaagctgaacatattcaagagcttcaacaaaatggcgataaggtagcctttgttggggatggtatcaatgatgctcctgctctttcaacagctgatgtaggaattgctatgggatctggtacagatattgctattgactcgggtggtatcgtcttagttcaaaatgatttaagaggtgttgttcgcgctcttgatatttcaaagaagacctttaatcgtattaaattaaacctcttctgggctcttatctacaatacaattggtatcccaattgcagctggcttattcgttggtttaggttttacgctaagtcctgaactagccggtttagctatggcattttcatctgtttcagttgttggtagttcactacttttgaacaaaacaaaaatcgctggaactaattaatgtaatttatttttatagtgataactagtttttctcaagtaaaaaatcagttctatcttaacgatatgagctgattttttattttcttaatttttgctccaatttgttattcatctcattttttgcaacccttttcattttatgagtggttttatttaaagtttggatacccttctcctataatgaagctggtagtcaaaatcaatggatgttaaaaaggagaataatatgttgtcaaaaaacaattttaaagaacgtctccgcaaaatggaggatagacaagatagattttcaattcgaaaattttctataggagcagtctctgtgttaattggctcatttattttttgtgtccaatccacacaagttgctcatgcggatactttggctgaaaaagatagcactgtagtatctactaaagacagttcaaaagtagtcgccagaggtaatagtggcacttctaatccgtcttcaaataatcagttacactctgctaatcagaccatcgatactaatacagctaaattggagcataaagctacaactggtgaactcaaaccagttagctctaatacaatctcagctgttaagcaacccactacagacatagagagtagctcaaaaaatcaaactctattaacaaaaaacaatgctataaaccaatcccaatctaatactcaagaaatctctaataatcaaggaaatagggcttccacgataaataatactagtgttaatgatcaggcaaataccaaaaaaactgatactcttaacacagatacaactattagtgacgcacctaattatcctgatacccatggtgtagtgcctacaacccaatacatatttgaccaatttactttaactaacggacaattgactaataatgcttatacacctttaaatatgcttattactcttactaccgatagaaataatcctggaaataaactaaattattacatcactaataataattattcagaagtatatgctaacgatgcaattaatgtagaccaatacgtaaactatactggagtcggtccatatccatcttcaaatttagtaatctataatttcggcccaaatggtattagcgttaatgaaaataataataatttcggcttagcatttacatttggttatggtaagtatgattctataattaactcaagtgatcctaatccattttcatcctcaaatgtttcaaatgcctggggagacacgacaccaaccaatgttacccaaactatcacttacgttgatgctcaaactggacaacctatgccaaatacgccaaccattgagtcaaatggattaacaggacaaatatatcaagttgatcctgcagccgaaaaaattataaaaggctattacttagttaataaagaaagagatcacggtgttatttctcaatataaaaatggtggaacttacactaatgaatgggtttctcaaagtggacaactaataaaagaagtatggcatcaaataaattctaatggtgttatgcaagttgatgtttatatcaataatgtacaaaaatatgatccaaataatttaaagggtattgtctacccttccacaatgtctaaagatggccctacacaattaaatatcgacaatggatcctatgtctttcctaatccatatgtagaacaaacaagtaatattgaacttaaatatgatccattaggtcatataattcctgtaacacctgatggtaatccaattccaaacgcacctactccgcaatatactaatagtcctactaatcctagtgcagtagagccaaatgaaccggttccaaatatcccaggatatacgccgaaagtttcaacagtaacaccaactgatcctggtacagatacaaaagtaatctatgttccaatcgaacaaggttcaataactgttaccgttcatgatgtaacagacaatgtaaacttacctcaatatggtaagagcagtggtgagcaagatgtaggtactagattcacttatgataagaatactgtaattacagatcttgaaaacaaaggttataaagttcttaatccagatgtagtaattccaaccactattagtaaaggtgctcaaaatattgttattaatgttgaacatgagcttgttcctgtaacaccagaaaatccaggaactccaggccaacctattaatcctaataatccagacggtccaaagtggccagacggaactgctaagaataatttagaagcaaccggtactcaaacaattcattatgaaggtgctggcaataagacaccagctgataatattcaacatttcactttcactaagagcgctacagttgataaggtaactggcaaagttgttagtgaaactggttggaatgtttctagtcatacatttggtaacgttgatacaccagtagtggcaggctatcatgcagataagtctgttgctggtggggctacaattactcctgatgacttgaataagacaattgtggtaacttatgcaccaaatggtcatgtaattcctgttggccctaatggtcaaccaattcctgatgctccacagcctcagttcccaaccaaccctgataacccaacaggaacaacaccaagtgaagttccagtagtaccaggatatcaccctgaaaatggtaaacccggtgatcctgtagatcctgttccaggtaagcctggtgaagatgttcctgtgaaatatgttccagatactccaacacctgaaacttataatggttctcaaaccattaagtttgttgatggaaatggaactgaacttcacactcccgatacccagaccgcaactaacctaactggtgagcacacatttggtaagatcaacactccagttattaagggctacactactactgaaactaccgctggtggagctactgtaactaagaacaaccctaacgctgtaattactgttacctacactccaaatggtcatatcattcctgttgggcctgatggtaagccaattcctgatgcaccacagccacaattcccaaccaatcctgataaccctagtgaaactactcctgggcaagttcctgatgttcctggttaccaccctgaaagcggaaagcctggcgaacctgtaaaccctgttccgggtaaacctggtgagaatgttcctgtgaaatatgttccagacactccagcccctgaaacttacactggttctcaaaccattaagttcgttgacggaaatggaactgaacttcatactcctgatacccagagcgcaactaacttaactggcgaccacacatttggcaagatcaatactcctgttattaagggctacactactactgaaaccactgccggtggagcaacagtaacgaagaacaaccctaacgccacaattactgttacctacactccaaatggtcatatcattccagtaggcccagatggtaagccaattcctgatgctccacagccacaattcccaaccaatcctgataaccctagtgaaactacccctgggcaagttcctgatgttcctggttaccaccctgaatctggtaaacctggcgaacctgtagatcctgttccgggtaaacctggtgagaatgttcctgtgaaatatgttccagacactccaactcctgaaacttacactggttctcaaaccattaagtttgttgatggaaatggaactgaacttcatactcctgatacccagaccgcaactaacttaactggtgaccacacatttggtaagatcaacactcctgttattaagggctacactacaactgaaacaacagctggtggcgctactgtaactaagaacaaccctaacgctgtaattactgttacctacactccaaatggtcatatcattccagtaggcccagatggtaagccaatccctgatgctccacaaccacagttccctactaatcctgataatccaagtgaaactactccgggtcaagttcctgacgttccaggctatcacccagaatctggtaagcctggtgaaccagtaaatcctgttccgggcaaaccaggtgagaacgttcctgtgaagtatgttccagatactccaactcctgaaacttacactggttctcaaaccattaagttcgttgatggaactactggcaaagagattgaaagtcctaatgttcaaaaagctactaacctaactggtgagcacacatttggcaagatcaatactccagttattaagggctacactactacagaaactaccgccggtggagcaacagtaacgaaggaaaatcctaacgctgtaattactgtaacctacacaccaaatggccacattatccctgtcggtcctgatggtaagccaattcctgatgcaccacagccacaattcccaactaaccctgataaccctagtgaaactacccctgggcaagttcctgatgttcctggttatcacccagaatctggtaagcccggtgaaccggtagatcctgttccgggtaaacctggtgagaatgttcctgtgaaatatgttccagacactccagctcctgaaacttacactggttctcaaaccattaagttcgttgatggaaatggaactgaacttcatactcctgatacccagaccgcaactaacttaactggcgaccacacatttggcaagatcaatactcctgttattaagggctacactactactgaaaccactgccggtggagcaacagtaacgaaggacaaccctaacgccacaattactgttacctacactccaaatggtcatatcattccagtaggcccagatggtaagccaattcctgatgctccacagccacaattcccaactaaccctgataaccctagtgaaactactccgggtcaagtcccagatgttccaggttatcacccagaatctggtaagcctggtgaaccggtaaattctgttcctggcaaacctggcgaagacattcctgttaagtatgttcctgataccccagaaacctacactggtagtcaaactattaaatttgttgacggtaagactgggaaggagattgaatctccaaatgttcaaactgctactaacttaactggtagccacacatttggtaagatcaacactccagtaatcaagggctacactactacgcaaattactgctggtggtgctacagtaactagagataatccaaatgctgttgttactgtaacttatattccaaatggtcacatcatccctgttggaccaaacagcaagcctattcctagtgctgatcaacctcaattccctactaacccagagaaccctacagaaactactcctggtcaactccctgtagttcctggttatcatcctgaagtaggtaagccgggggaaaatgtaaatcctgtcccaggcaaacctggcgaagacgttcctgttaagtacgttcctgacactccagtcaaaccaagcacaccatttacacctactactcctgaaacacctagaaataatccaactcgtccttcagaaactccaattgcaaataacgttgaaagtaacaagaagaaggaagagcttccacaaactggaagaaaagaaaaccaagctcaactaatcggattagcagtagctggtattagcttcttacttggattaatcggtgatcggaagaagaaagaatagcttaactttaagcgaataaaaaatgcgctaagattaaatatcttaacgcatttttctttgctcatagaaaatggattttaattaaaaacatattccttaaataactactttttattctttattctcagtactgttcctaaactagcaaataaggcagttattcctgtaactagtaatccaaagaatgtttctctttctccagtcttaggtaattctttattattgctactcttagtacttcgagttgaactatttgtagtattttgagctttattgctatttttatgagttggcaccttattatcagcattcttctttgaagattcttgagcacttcttgcaacttgatgctttttccctactaatgtgctgctctctttatcagatacagattcagcatcttgtttcttttcttctggttctttcacttcatctttagacgttgatgcagaatgagattcagattttttagcttcttcttgttcattcttagataattctgcctgatgttctacttgtgatagagcatctgcaggtgtttgccccttcttctctactgaagttccagttcctttatcagatacagagtgagcatcttgtttcttttcttctggttctttcacttcatctttagacgttgatacagaactagattcagattttttagcttcttcttgttcagtctgcttcttctcaggagttacaactggttgttcaaccttaggcaattccacttgatgttctacctgtgttaaaacacctgtagcagtttcaagtactttttctgctttttctaagctgcttgcagatgcatttttatcatttaaaacatcccggacaccattcaatatttctttgaatttatcttgcgattctggcgtatatccgtctaagtttacattggcattcttattaacctcttgttctaatgcctctctagctttatcaacttcttgagtatcagattcagcaggcttattttcttctttcttaactaagcctttttctgcttcaacaagactatcttttgctttattaacctcgtctgcttgtgcatcttttgaatcgagtactccttctgaaatcttttcagcattatccttcactttagcagaatcatcagtatactgagatttatcttcatctttatgcttattaagttcttctcttaattgttctttagctgtttcaacatctttatttgattctgttttttcaactaaatctttctcagcttgagataaactatcaagtgcttcttgaacttgagctttattagcatctttattagtcaaaacctgatttactttcttcagtgcattactcaagttttctgcactctcagaagtatacttcgtggtatccaaatgactaagtttgtctgccttttcttttaaagcattctttgcagcaaggacttcctcggtatctttattttcctttggtgtatcttcttgctgagttgttttttctggagatacttgcttttccttaagagatttcgttgcattaacgatagaatctatcgcatcttgaacatcagttgaatttgcatctttattagctaaaactactttagcttcatcaagagctttagttactttttctactgaatcatcagtatatttatccttatcgaatttttcaccagccttaactgtctcttccaatttttctttaagtgcgtttacttgtgagtctttatcttctactttgtctttatctttattttgatctacaggcttttcaaccaaattcttaattgcttcttctagttgttcgcttgcctgcttcaattcttggagagtagcattcttatctttcaacgctttacttgcttcttggcgagcttgagctaattttttagctgattcatgtgtgtacttacctgtatttcctaaagcacgtgcttgatcaagcttctttcttaaatcttttcttgcttgtgcaacgcttttatctacagtactctcttcttttccaatagttttgacatcatactcaactacttcggattcattaccgtatttatctacagtcttaaatagaagcttgccattatttttgacagttacaccatcttctggaagaacattgtatttatttccattatcagtactgtataaaacgttgccatctttagcctttccagttacagttactgattttttatctgacgctgttgtagcagtaatttgcggtgaggccaatttctgagctttcttatagtacacaactaaagtttggacttcactgcggttatcattgttgtcgactactacaacattaaaagtatttttgccttctttaagtttaacagaatggctaaagctcttcttcagattcttattaccgttgtaatcaacatcatcccaatttgcatcaacattattatcatttatgagcaaactataatatggataatcatcactaattgtaccttgaagcttaaattcttctttatttgtataaacaggtacataacctgattgatccttctcttggttaagggttaattctggattatttgaatctacgtagaatgttaagcgttcttgaacagtatcattaacagtagtatcaccaattaaaactgggaaaactttagctccatgcttaccaagatcaagtactagtttaaatgttccatctgctttaactttaactgtatgatcaccaattctaacagtagtagttgggcgatttacttttccagttaaagttaacttaccagtcttaggatcgtagttttcggtctcggtattaacgctagttgttccaaacttaattccattatcaaaggtaacatcctttgcggaaacaacagtcttaccacgatcacttgacttaacaatttgcttaacagatgaactattcccatctttgtcagtaagaacaatattcattgtattttcgccgtagcttactggaactttaactttaaaggtgtgttccttagttggtttagcactataagtcttacctgcaacttttacagcaactttatcagtatcatcactaacttttcctgatacttctactgtgtcttcagaagtttgacttagtttagcttcttcatttccagtatatgtttcttgatcatctactttaagactttcaagttttggtggaacaagactaacattaatacgtttttgagtaattagtgtttcatgttcttcatcagcatagaatttaacattggtgtcatagtcacttactgataatggcaacttagtaacaaaccgttcactagcttcatcataacttatgttaagatcgtgttcttttccatctttatctgtatatgtaccatatactttctcgggatatgtacctgaaatagtatatgaatcatcagtcatatcataaccatcgcttaccgttgtgatcttttgcggcaagttattatcaataattagtccaaagttaatttcacctggtttatttgatgtccctgaattagtaccagcgttagtagcattatcaaatacagcaatagctaaatcattttttccagccctaagagttttaacttgctcatcgctaagtggaacttcaatcttttgataaccatcactagatgaaccaacaatatcatatgcgacacttctattaagttctccatttacataagtatttgcttgtccatttaatccactgaagttatctttcgcttctgctttaagaacatatgatacttttccagtttgatccttatgtgatcctaatttcaagtttttaacttctggtttcacactatcaactttaactttaatatcataatgttgctgcttcttagtaccatcaaccgtaccagtcacgcgataagtataagttccatctggtactttttcggtcttatttgtttgttgattgaaatatgtaccatcccaagcaggtgcataattaaacttagcatatctttgactacttgctgcccaatatgacttagtaacatgtgccaatgaaactagcgtattaattacttcaccatcttgatttaagatttcagccttaacatcattagcatttctaaacaagaagtattgtggtctcacccacgatacagatgctccatctgctgtagataaagcaattgcatctggatcaactctataatttccatcttcatcttggtttaagccggcataaccaactgctccatttttatttcctgcagtcacaatagttccgaggttattatttcctgggttaaatgctaatccgtttaaaccatcaaaaatagcaggtgcagcccaatcaccaaagaatcccatgtatggaatctttaaatgtgagttatcggacccagtaaatgccataaatccttctacatattgattttctttaaagttatcaggtaatgataagttaatagttacttctttagtagagtttgctggaacaactatcttttcacttggtgtaagtgaagcaccatcaatcttcttttcgaataagacacctgtttttggatcggtttctgaagtatatacatcagaaaacttaccgttctcatttaaaccatattcaatgtctttattggtccgatttgtaaatttaatagtaaattgatgttggcgatcctggaaatctttcaattcaacaccaggataaccattacttccactaacagttgaaggattatgcaaaatagcattaattgcagcctctacattgactaagccggctccctgtctacgaggtgattcaataactgagccatgatcaacgtcaacttcaatattagcagtattcatctgaatattttttattaaagctgcacgttcacttccagacatcttttggtatgtttcataaaacttacctgtcttatcattcatagcttgtacaagtaaagcttgtgatccagcaataaatggtgaagccattgatgtacctgacatattgatataaccattattattttggagagaccaaatatttcctccgggagctgtaatatcaggcttaaatgatagatcagatactggtccataagacgtaaagctagacattaaatcttcttcacgaataacattgtttaatggttgaacttcaacgtttactcgtaataattcatctggatgagcttcaacataagcaacaagcttattaccatcgtcagttgataaaccagctgtaggaaaaccttcattgtataaaactgacgttaatggcgtatttcctccagcattatttacaataataagtcctgcggcgccagctgcttgggcatatttttgtttatcagtgaatgtaatttcacctcgcgaaacaactgcaacttttccttttacatcagctgtatattgactaggagttcccattcctagttttccagatgcatcttttacaatatagaattttttactatcgaaagcatcgtgagatgtatttggagaaagttgcgttacacttggtccaaatatctttttgccatcagcggtagaaacagtcatcccatcggtagtaaccttagtattttcagcagatgcaacagttgtagcacttctactagtaccaggacttccgatagtttccatatcaggattaccataaaagtctttattaactccctcttgattagaggttgaagttccagagtttccggctgaaattacggctgctgttccatgcttaacagctttttctacagccgcgatttctggatcatcctcagtttgttcaccagatacagatcctaatgacatattaaggacgtctgctcccaatttagctgagtcatcaactgctccgattacgcttgttgaatcggttgtggaggagctatctgaattagaaaaagccttcatcgcaagtaattgtgcttcaggcgcaactccaactactgagcttgctgaattcttcccagtaccattagcagcaacaattcccgcaacgtgcatcccatgttgttcctttggatcatcatccgtaataatatcgttattatctgaataattatgtccaaatggaactttactggtaaagtagcgtccatatccactattttcagtaaatccatcaatatccttagcagtcaatttaaccttagattcatcacttaatcgtaaatctttatggtttggatcaattcccgtatcaataattgaaacaactgttccttcacccttatattgatagtttgaccaaaccgtcgaaacattagccatgttatttgctgaggtatcggctgcaaaatataccttagctaaagtaactgattttacacctttaatctctcttaattttttaatatctccaacttttgcttttgttgcaaaaccattaactacatacccataacttttatcaatggcttgattcgtaattttttgaacttcatccttaattccagattgagcagcaattactttattcgatgcttgctcaatttctgctctacttgctgtttgtgaatcaattgatccattttcagaagctggtagagcctcgagttggacaatcacatctacatagacctcttgctgttcctcgggtgttaatcgttcaaaattaacaccttgagcggcaagttgggcctcaacagcttgtctcgagagagctgtcgtagaatgttctacagctgtcttagattttttaacgctgttagtttggctttctacacttgcctttataatttgttctcctccacctagtatttgaccactagttataagagctgtactgagtaataaccaagtatatttttctcttttctttttcatttaaatcctccttaaagaattgattaactgacccttgtaactaacttataataaaataagaatatatttaatttgatatatttttattttaatattatatccaatttatattaaagttcaatgcttttttatacaaaaaaataactatcaaatgtacagtatttactgctttcttccaaatcgtactaataatgtagcaaaaaattaacattgatttacaaataaataactgtttaaattattaaataaatattagtataatgaaagtttttccattggaggtttatatgaaaagaataattaaagttggtgctttagcagcaagtagcttttctttattatttttagctggttgctcttcaaataataaagaagttgcacaatatggcgataaaaaaatatcgcaggagcaattttatcaggaactaaacagctctccgactagcaaaacaattctagctaatatgttgatctacggagctcttaaagaagcgtacggcagtaagcttaacaaagatcaggtagaagccgactataatagttacaaaaaaagatatggttctcaatttgattcttttttaaaagaaaactcctatacaaaaaaatcttttaaacaaatgattgaattaaatcatctaagtaaaatcgctttaaaaaaacagatgaagccaacgacttcccaattaaaagaagaatggaaagattatcaaccaaagatcacagttcagcatatttcaactactagccgcgatacagcaaatacagttattgagaaacttaataatggtgaaagctttgctagtttagctagcaagtattctgtcgatagtctaaccagttccaatggtggaaaattgcctgcttttgatatgcaaaatagacgatacgactctactttcaaaaagggcgcctataaattaaaaaatgatgaatataccaaagaacctatcaaagttacaaatggttatgaagtcattaaaatgattaatcatcctaaaaagggtaattttgctgataagcaaaaagaattaactgaagcaatttataataaatgggctagcaactctagaattatgaataatgttatcagtcaagtattaaaagaacagcacgtatcaattaaagacaaagatttaaaatcagctcttgatatgtataaaggttccaataaagcaaatttttaaatactaagaattaataatatatagaaaaaactctattaaattttggtgttaataagcctcgatttaatagagtttttaatttgaattaagatttttaaaggattaggcgctaaattgctgaaatgcaattttagtagaaccagtaaatgagttattcccgtaatcaacggaaattattggtaagcccttatagaaagtcttttcacatttcgctctcaaattaagcaagattttgtgtattttaaattcaatcattaattaaggcaaactctatatcctatgaaatgagtcaactatagatccaattaaaggcttccctttaccaattgtctattagactttttctacttcaatcttattaatagagtatagtttcaaactcatcggtacgttaattttaggaaatttcatcttactgcatttttatttaagttatttttgttatataggcagccttagactatagttattttaattactactttgctgctttaaagtacaaaaaaccgagacccatttctgaatctcggaagtaatagtttattttaaatatctaatttattctttaatctcaaccatcatttcttcttcacgtttttgttcaatcttacgaagccatggtaaaacgaaacctaaaccaaataatacgacaactgtaataatgttcatccataattggtgagtaaatgccttagtaccaacagctacgttttgaggaataaatcctaaagtagcacagacaaaggtaaatagtaaacaccaagaaccaactgttaacgcaccagccttattcttaatgaagacatagcttgagtggtatttttcttggtgcattctcattgcaacaaaggcaaagaatacccaacaagtcttgtatggtgagataattccgtttacgtttaatagccagttataaatggtattgatattaggtaaagttccagttaataagagcaagaacaaactaagtccaacagtaaaggtgtaactgtgaattggacggccattcttgttcttcttggtcaaccattttggcatgaatttttcgccaacatctccggcaaatacacgacttgacgcatctaataatacggcaagttgagccatcataaagattgcttgtacaacggcgaaaatatacatcaataccttacccattcctaaactttcacctaaaagttggaaagcatagtaaggaccgttcatcttaaagtcgtgtggaatcttgtgagcgttgaagaacattgctaaagctaaggttccaaaaatagtcaagaatcctgtcataattgcaagcatccacattgctttaggaaaatcgcgcttaggattcttcatttgttgaacatatggtgcagctaattctgcacctgacattgcaaagattaaaagaccagtagttgagaagtagttcaaactaaatgatggtttaaatgctccccagttaaatggttgagttgcaatatggtgaccatgcattactgaccatgcagctaagagcacgaataacatggacataataaacattgctcccccaccaattaaggaaaggatttctagcgagttacgtaatttattttctaataaaataaagaccaaaatgattacaaaagtcaaaattccgaaccagaaagttgacatcttcttgtctaagctgttgttaccaaagattatccaactgaaagaaacgataactgagtttgacacgtcaacgatatatggcacactctgaacccaatacatccatgaagtccaatatcctaaagtatcatttgtacttcttcttacccaggaagcaagtcctccatcttgattatcaaaagtcaaactcatttgactactgattaatgcgtaaggaataacataagtaaataaaagaaagatccatgaaattacaactgaaagaccttggttttgaaatggatagaagatattttcaaaactaataatcgttacaaagtcaatcagcgcaataactggccaactcatataatgttttttattcagttctaaatcattaaagacatctggtttatccaatttttaaattcccccaaaattaaaatatttatctaaatcctatcttctaagtttggaggtttcaaaactatcattaaagtattcgaattcacttgtagaaatcctttataaatcgctataatttatgccgtagtagtcttgcaaataaaattttgtacaaaaacgtccgcacaaaattataaagatttctaaaatttttgcaagtctattttagaaaatatagtaggaaaacaaggtgattaaatgaattttctaaaaattgcattaagcaatcaacttaaaaataatgattttaattcatggcaaactactaatttgaacgatgaaactcaagctagtgaacttgccgctattgttgtagcagagactgataaaagtagtcttaaaactgctcaagatttacaaaaaaaatcagggcttggaattcctattattaaagtttcacatgaaacaatttctaataatgaaaaaaatcaaataattgatgccgcaaatcaatacacagcagaaatggttcctggctttttaactgatttggtcaatttcgcagaagatcgtccaattagttttacgacaccaggtcatcataatggcttatattacgaaaaacatccggcgggggtagtatttaatcgcttctttggtaaaaacctcatgtttgcggataccagtgatacagtaccagaattaggcgatactatgacccacgaagggacgcctttaactgctgagcaaaaagctgccgaaacttatcatgctgataaagtttatttctgtactaatggaacaacgagtgcaaattcaatttgtgcaagtgcactattaactaaagatgacctagttctttttgatcgaaataatcataaatccctctataacagtgccttagtaatgactggtgccaaacctgtatatattccaactgatcgtaatgcacttggattaattggagaaatggatcctgactttttaaatgaagaaaaaattcgagctgaaattgctaaagttgaccctgaaaaagctaaagctaagcgtccatttagactagctatcattcaatcagaaacatatgatggtcttttttacgacgcgaagtggatgattgataaaattggtaaactatgcgattacattctttttgattgtgcttggggtggattcgaacagtttgttccaattatgaatcacctgtctcccctcaacttagactttgggtcagaagatccgggtattttagtaactcaatcacttcataaacaacaagccggaatgggccaagcctcacaaattttgaaaaaggatgctcatattaaaggtcagaaacgttacgttgatcataagcactttaaccacgcttatcttaaatttgttacctcaagttactcttatccactttatgcctcactcaccgttaactcatatttaaccagcggtgagggtaataaaaaatggtgggaccaaatcttacgcttaggaattgaatggcggaaagaattaattaaaaaatcaaaattatttaagccactagtaattgataattttgaaaatattagtactgatgagttagctacaaatgaaaagtactggaatttagattccactaatctgtggcatggatttagcaaaattgcgtctggtcaggccatgatcgatcctctaaaaattactgttgtaactcccggaattgatgttaaaaatgcaaaatatgaagaaataggtattcctggaccagttgttgcagaatttttaatggagaagcggattattcgtgcaaaagatgacctatattctcttcttttcttattaacgccgggagatactaaggctgaattagatatcttgctgaatgcattcttagaatttgaacaatattataacgaggatgcacctctagacaaagtgctccctaagctaactaaagtatacggcgatcgctacaaaggttataccttaaaacagctctgccaagaaatgcatgaatattaccggggaaataatacctttaccctccagcaagaattatttgcgaaaccagatatgcaaaattatcaaatgactcccgagcatgctgactatctctttatgaaaaatgaaagtgaattagttaacttagaagatgttaaaggtcgcattgctgctgaaggtgccttaccttacccaccaggcgtgttcattgttgcgcccggcgaaaaatggagcgatattgatcaaaaatattttgaagttttagtaggtgctatcgagcgtttcccaggctttgtacctgaaattcagggagtctactgggatcaaaaatcagatggtaaaataagagtacaagcagaagtattaaaggagaattagtaatggttttatcttggaaagaaaacttaccaaccgaattaaaagaaaaagtcgataaagtcgataaaatgattgaacctcgtctagaagaaattgatgagcaagtattctataaccaacaacgtgttttagatatatttagaaagcatcgtgttggagaagaagatttagttccttctactggttacggttatgacgacgttggccgtgataaattagaagcaatgtatgcagactattttaaaactgatgatgcattagtacggcctcaattttcttcagcaactcatgctattgctgttggtctatttagtatgcttcgtcccggcgacacgctctactacttaaccggtatgccatatgatactattcaagaagttattggtttagctggtgacaaaccaggcaacatgaaagaatggggcattgactttaagcacactgatttacttgataacggtgaagttgactatgaacaagctagaaaagacttgcaagatccaaaaattaaagttgtaactattcaacgttctcttggttacgctgttcgtgcaagctttacaatagaaaaaatcaagaagatgcttaagtttattaaagaagttcgtccagacgtaaaaatcttcgttgataattgttacggcgaattttctgaatcagaagaaccaactttctatggtgctgatatgatggcgggttctctatttaagaatgcaggtgccggaatcgttaaagcgggtgccttccttgttggtaaaaaagatctcattgaaggagcaggctcacgccttaacgtccctggtgctggtaaaggagaaggagctacatggggctatttaagagacatgtatcaaggattctttatggcagctcacactactggggaagccttaaagggtatgatttatactgctgctctttgtgaagaaatgggaatgaaagttgcacctaagtggaatgatccaagaactgatatcgttcaaactgtaaccttcggcgaaccagatccaatggttaagttctgtgctgctattcaacactattcaccaatgaactcatttgttgatcctattccatatcaccaagatggttacgaagatgacgttgttatggcctcaggaagctttactgaaggttctacgatcgaattatcttcagacggtccaatgcgtccgccataccgtctttacgtacaaggtggtctttcttatgcccatgacaagattgccatcactcatgctgtagaagaaactttctataaaaaagattagtacatattagtatccttaaaaacggtcagtgaacatcatccactgaccgttttttgatctctttattaagttaatgcaaaatcattttttctttagtctcttctacaaatccacgactccgatataatcttttcgccttgatatttgtggaaaagacctctaaaaaagcgggacgttctaagcaaggaattacagtatccagtaatttaccaccaattcctcttccttgaaattcatttaacacataaatatagcctagttcgttttctctaaaagccacaaaacctactattttgctatcaatcacagccacataaattgtttccgaaaacagttcctctttatacactgccacttcaagtggagcatacagatcaaccgcattacctacaattaattcttgcattctggcttgatcatgtactttgcataattgaacatagtctatatttttatattttctaataattacttcttctgacataactaacctaatttctatttaaaacatcaggagaaataaactcctgattaatggctaaattggctagcttttctacgtaatctcattatcttacctgctttcttatttttaacaatgttaatatattattaatatcattgtcaatatttaatttgaaattaatatatttttgcatccattaaagttttttgttagggtggaagatatacttatattttttaaggaggactttttcgagttaatctaagtgctttaactcatattatgcaaaaagaaaatttgaacaatacaaatactatcaaagaaaaaaagaactataaaaaggctccgctgatgcccattcatctacgggtatttactgctgtattattagggcaaattgcctgtggtttttccctaggtatttctgggactgctctttctagcgcaagtaaatatattacaatcagtgatctatggactggattaattggtgccggatctttaataggtttagcgggaagcatcttaattgggcgcctatctgataaaattggcagacgaaaattattaatgctaaatatgtatatcctaggatttctatcattaacccaattgttaactaataacttaatacttatttttattattagaattctgattggtttaatgattgctgtcgactatacagtgggaaatgctctcttaacagaatggctgcctaaaggcgaagatagtaaaagacaaagccatcttcttatttattggaccattggattcattgcttcatatttaacaggaacctttattactggctttggttcttataattggcaaatcattttatctaccggtgcaattccagcgtttattgccgctatatttagatccattttccccttacctgcttcaccaagttggcttgctagtcgtggtaaagtgaaaaaagctaataaagttatcaaaaaacatatgggacataaatggggccttcctcaaaaattaaaaaaggctaaacccgtcaaggaagtttcttggacaatattattttccaggaaatatttgcgacaaactttagtcggtggccttttctatgcttgccaagcctttgcattctttggtatcagtatttttcttccgattctcttacaaagtatgcatgttactgatcaaaaaatttctggcattatctataatggcggtatgttcattggggtactttttggaattttaatttttaacaaaattagtcaacgtgcatttttaattagtaactttttactctcaagtctcttgattggtttcctagcagtcaataaaaatattaattccaatattcaattgattatcttttgtatatttgcaattgttttatcgtctggattagtacttgactacccttatccaactgagctatttgatattaaagttcgaggaacaggagttggaacttgtatcacaattagtcgttttggggcagcagctggtactttcctattgcctattttaactaatctaggtggagcacatctggcaatgatcacttgtgcttttgttctctttgctgcctttgtcatctgcttaatctgggctcctgaaacttcaccccaattcaaacaaaataattgatttgatactacttttttctaaaattaagtattagaaaggatgagggtgattcctatggtaaaaatgacaattagtcaagatgcaatcgattttcttaaaaaccgtggttataacaaacatgaaatacttttaattgttgatggcggtggcggcgactactcgattgagggcggatcatgtaatattggaatggattattcactaatttcacttgatacaatgaagcacgatccacgctactcagtaaaaattgaaaataatgctaattttgaaatttatacttctgactacgatttagcatttctcggtgacaatttgatccttgatattcataataccaccttacgtttacgtaacgattcgggcatcttaactggcgccgtaaaaatagcaaaggcgagctttttagcagaacgagctaaagaaggaattattgatcaaaaaaattgttaataaataacttttactctcaaatataattttgagagtttttctttacactactttctcattttccaatcctgttattccatttttattttgcacaatagctatagatttattttctaagataataaattgtgatacccaatattccatacatcctactctatttttaaagtgtttttattaaacaatatttcttcatcgtggcttatcataattatcatgcatttcttcgatatttcctccaaaagttgaagaatgtcttttttcatagaggaatggatatttgccataggctcatccagtactaaacactctacatttttagtcaaagcagaataaagttttactaattgaagttctcctgaagaaagagtatccatttttttatctaaaaaatgtttaatattaaatctcttcgaataaaaaacttgggaataatatttattttttattttatcaacataattttctagatattcttcgaccgtacaagatggtatatctatatcttgaaataaaaagcctatattatttttcctcatttcttttctatttattttctcaacctccattccatttataaaaatatcccctgaggtcttagagttatagattcctgttatactacgtaaaagagttgattttccaataccatttttccccgtaatcacataaaatcctggattttcaaacctataggtaacagtatttttaaataattttttctccccatttaaagaaatattcactttattaagaaagatattttgaaccgtattgatttttatagctccatctacttcaggtttcatactaagaagattatccattcgtgcataagatgctttaaaagattctattcttaccaatattgaaaatagattgtctgcttcacttaataattgattaaagtattgtagaataactgaaaaatatccaatagttatttttcctgctattacagacattccaccccaaataaaaagaaaaagttggaaaaattaactgaattccaatttgtaaaagtgacataacataattaagaacaaagtccttatgtccaattttcaatagtttattttcagtctttcttaaactgaatctgttaagcgctatttcttcttttccctttatctctacatatcttcttagccaatcagataattttgaaaaatattcattatatatatttttcaaatctagactaactgtgtacattcttggctttaagaagaaataaaacatagtatatataaataataataatagtattatccaaaaataaagaacattcgttttgataagataaacaagaattatagctaatgagaccaaaagagcaattaactggcttatcgtctgaaaaataaacgatatcacttcagtaatatcatcattaacctgatcagttaattttatcggatccttttttagtatttccaatgtatcttttttatatagctttttgattaataattcattcgcatataaaaaagctcttctataatcaagtatttgaactttatttgtaaaaaaggataggataagttttaaaattcctagaaaaacaaggagacatagtattttaaaaaaatttcctctatctttactataaactaaagaatttagtaactgtccctctaaaaaaatatttccaatcattgctatcgtatttaccatacttgcaagttgtagcaataatatcttatatttatttctttttataatgctttttacaattgttttcataatttctacattttctttaactatccttactttgcttcctattaaaagaaactcctacttgagaactaaggtagtctgatacctaaccatatgagactttttttcatttaaagttgaataaaattataatttatcttattattattttcaatattttttaatgtggttttatttttaacataaaaaagatctcattacattttaagtaattttagaaagttgggtgtaatatatctttgattaatcttaaaaatgttatatcattagaatcaataatttagaaaaggacatattgctatatgatgctaattgtattttagtctcaagggactaatctaccttcccttgagaaaaaacaaatttaaattctattttcttaaggagaaaaataaaaattgaataatactgacgaaatcgaattttcacgtgtacgtaaacttgtagctggctatgccgtttcaccagaagctaaggagaaaattttagctcaaccacttgcaaacaagttagtcaaagcaaatgcgttattagatgaaacggaagaaatgttctggattttagatcatggcctacacatcccttttattaattcagatgcttttacgccaatcataaataaggtgaaaaagggatatatcttaaatccccgagaactagaacaagttgctgactttattagggttactcgcttattagtacgcttttttgataaacaaagacttaaggctccaattgtggccagctattgtgatacgttaactattctagatagactagaagaattaatttatcaagatattgagcgcggagaggtttcagatcgagcagataaagagctgactaaactacgccaaagaagtagtaacttaaatacaactatcaaagaaactctacagaaatacttgcagacaaaaaagtaccaatcaatgttgcaagattttcagattattcaaaaagatactcactatacgcttcctgttaaggcaagctttaagcatagttttggtggaaatattattgatcaatctaataatgggaccactgttttcattgagccaaccaagatagttcatcttactcaagaaaaaactacagtcgaaaatcagatttacttaattgaatctcaaattttgggaaatttaacggcaaaaatctataatgagctagctcattttgaagccaatcttaatgttattgttgatctagattgtatcttagcacgtgcaaaatattcgcatactactggtggcaaacgcccaattttaaatgaacaaaatgagcttcaattgaacggaatgaagcatcccttgttaagtaatcccgttcctctatcccttaagttagatccaactaaacatggcttaattattactggaccaaatgcaggtgggaaaactgttacactcaaaactgttggcttagctactgcaatgactgaatttggtcttttcttacctagtgcagcacggtgctccattccgattatgaccgaaatctatacttcaattggtgatcatcaagacttagataactccctttcaacattttctgctgaaatgaaaaagatggcaatgattgttcaaaaggccactccaaacagtctgattttgttagacgaactcggtagtggaacggatcccaatgaaggtgcagctcttgccattgctattttacaaacgctacaattgaaaggttgcataatcttagcaactacccactatagcgctataaaagattattcgactaaaaatcctgcttttattacggcagcaatggattttgacttacaaactctacaccccacctataaactacttttaaatcaagtaggcgccagtcgtgctctctggattgcagaaaaaagtggtatgcccgacaacgtactgtcagaagctaaagatttcttaaatactggaagcttgcctttaaagcaagcaaatattaaatttaagaataagccgaaaaaagttaaacctctaccttcttttaaaaaaggtgatcgaatcaaagtaccaaaatatcaccaagaggtcctcttttatgagaacgctgatatagctaatcagattgtaatttttgttaataaagcttttgagactgtccctataaagggagcaaaattagttcgaaaagctgaagaactttatcctacagggtataatctcgatttattatttatccaagattggcaagaatataaactaaacaaggatttagatcgcggttctaaaaaggcctggaagaagttgaaaaagtaacaacgcaattatttaaataattataaaaataagctctccagcttactttaagctagagggcttatttgtgtttattcagctatctttatccatcaagttctacgccctgcaattctttcattgcatcataagcagctgatcgtttattatgatcaactccaagaattaacaaatctcctgctacaattacagtatcaccatgaggaattatttctcggcttccccttctaatcgttctaacaagcacattatcaggccagttaatatccttgatttcctgatctactaacttactattttcatacacagggatatctaattcatcttcttcacccgatattggttgtaaacgtgtttctggcatcatagcggctgccaagctgtcatagattggcttgccaccaagaatttgatcgattaaaagtgcaataaatgccacaacagccaatggcattaagtgaagaagcgatccgaccatttcagtaatcaaaataattgctgtaaatggtgcgcgaattatcgccgcaaaataacctgccattgaaaaaattattaagttaataactaagtgtgcaggcattaaaccaagttgtaccattaatgtaccataggttgccccaattagagcgcccatagttaaaattggcaaaaatataccactaggtaaacctgaatcataagaaataattgaaaatgcaattcgcagcacatagtaaaatgctaaaattccaactagtgcccatccactttgagtgagcattttttgtaaagataaaatcaaacgattacctggtccagtaattaacggccaataatacataattggaattaaaattgctaatggaattaaaccatgtagccaacgtggtaaccaggtgatttttaaatagactttttttaatccaaataaaccttttttatataaatggcctaatagtcccaggataattcctaaaatcaccaaatgccagtacaaataaattggaaatgaatgatcatatggcatccctaaagcatggtgtaagccaaaaaagtaggacaccataaaattagcggcaattgctcctaccaaggaattcatccaaactcgcggagaaaaattatgaaaaatttcttctaaaacaaatagtgctccgctcaatggtgctccaaatgcagctgacaaaccactggcagctcccgttgcaagtaacaccctttgattgtatttactttgttttagcttctcacccactccttggccaatggatgaaccaagttgaagggatggtccctcaggtcctagaaacaagcctgttccaattactaagattcccccgatgagctttctccacaaaatctgccaccatttaagttggagcttaccttgaagctgtaatttaacttccggaataccggatcctccaacgtgtggatactgtttaacaaaatatcccgctatgatccctactgcggctaacccaagaacaattgcaacaaaccaaactggattattatgggcctctttaaaaagatagagccaaaaagcagacgtcttttcaattccaaatctaaatagtccaactacggcacctgcaattagtcctacaattaatgcctgcagcatcaattttagattatctttttcttctttcctcattcttacttacctacatccctatttattagatactgctttattttaacgcaaaaagtcactacatctgtagtgacttttttagtttcatgtgaaacattgttatttttcttcgtaccattcagtatggaaagtacctggacgatcatttctttggtaagtgtgagcaccaaagtaatcacgttgaccttgaataatgttttgaggtaagcgtggattaaaaatagattccaagtaattcaaagctgcactaagagttggagttggtacgccagcatcagccgcaattttaaccacatctctaagagcgccaatattttctttctttaccttatcaaaaaatggagccttgaataagttaggcaagtctttatcagcattatacgcaaacttaatatcatgaagcatttgtgagcggatgatacatccagcttcccagttttgggcaatagttgaatagtgcaagcgccagttataagcttttgcagccatcgttaattgctcaaatccttgaccatatgaaacagccatagctaagtataaggcttttgcaagttgatcaactaagtcctttggagctttctctgggtcaatctttggttcaggatcatttctcaaagttgcttttgacataaaacgagcaagaacggcttctgcaattacagtaattggagcacctaaacgaattgcatcttcaagcatccagttaccagttcccttataagaagcttcatttaagatatgatcaataatatgatcatcagttaagttatccttttgttttaagaccttagaagtgatttcaattaaataagcttgtaaaccacccttatcccaattcttaaagatttcactcatttcattgtttgaataatgaccaacggtgcggagaacatcgtatacttcagaaataatctgcataataccatattcaataccattgtgaaccatcttcacatagtgaccactacctgctggtccaatgtatccgacacatggttgaccagttggagtcttggcagccatagcttcaaggattggcgctacttcttcataagctttttcatcaccacctggcattaaggcaggaccgttcaaagctccttcttcaccgccagaaacacccataccaatgaagtgaataccatgcttttccatttccttatagcgacgattagtatcatggaaattagaattaccaccgtcaattaaaatatcgcccttatctaaaagaggcaatagtttttgtaaagtttcatcaactggtttaccagccatgatttgaatcaagatttttcgtggcttttctagtgaattaacaaattcttcccaagtataagttggctttaaattcttatcttcatattttgctaaagcatcaacctctggcttatcaattgaaaatccagagacagagtagccatgatttttaacgtttaaggcaaggtttttccccataacggacaagccaataaccccaaattgttgcatatttttgcctccacatatttaataaaattcgttcatctactagtatacttttttattatgaatttcgcacaattttgcttactttttattaaaaaaataaagagtccagctatgtgaactctttatttaattatttcctaggaaattaatggcgtgatgcacctgatgaagcatcttctttagcttcaactggctctgcctcagtatgttcagatgcaccagaagcagcatctgcctcaactccatacttaccagcaaagtaactaaatggcttcaaagcttgagcatcatatttagcaacgaaagctggatcgtctaaagtatttaattcagttgaatatggcatgtcatgagtaatcttacagtcgatcaaaactggtccttccatttgttgagcagcagctactgcgtcttcaaattctctcttagtacgaacagtaaagccttttacattcataccttcagcagacatagcccaatcattatcaggaagttttacaccagataatggttgatgagactcatcgacttgttccgcttcaatataacccaaagtttcatttgtgaagaccacattaataatatgcatattgtagcgtgcttgggttaaaagctcttggttcatcatggcaaagccaccatcaccagctaagttccaaacctcacgctttggataaatagtagcagcggctaaagcagctggagcgccatagcccatagttgcatataagccggaggtagtccatttctgatcatcatgtaggtgcatcaaacgatcaaagttaatatttacattacctacatcgactgcaaatacggcatcattagcagccttgtataatggagattctgcacgcccttcacctgcttcaattaaggcacgtaaagttttcttggagtcagctaacattggaacagttacagcatgacgcttacccaatctttctgaattaatatcaatttgaattacttttgccttaggattgaagaagaagatagagaatggtgaattgttaccaacccaaactactaaatcggcatgagtttgaatgtcattacttggcttagcacccacacgaccaattgaacccatatatgctgggaactcatcctcaacaattccttttcctaaaactgatgagactaatggcatcttaaatttatcagaaaattcctttaactctgcactagcatcttgggcaccatgaccaaagtaaataattggatttttagcttctttaattaattcaagtgctttatcaatttgttccttgcgtggtgctgggaaattaggaacaatcttgtgtgctgcagcattattacggaagttatcttcaatcttatcccaaccaaaatctttcggtaagattaaaacagctggacccttcttttgataagcttgacgaattgcttcatccattaaaactggaatagcttccgctgtctttgcttggtgattccaaacagcgactggatcaaaccatggcttttcatcaaaagcttggaagaaatcaatatcttgacgacttgttggaacattagcaacaattgcaaccattggtgtcttgtcatattttgcatcataaagtccattcattaagtgaacggcaccaggacctgcagaaccaaaacaaactcctacttttccactaattttgtattcagcagaagctgctaaggcaccagcttcttcatgtcttacttcaataaactttatcttatctcgccaattatgaattgcattcattgttgagtcaaatgagccgcctggaaaaccgtatatatggtcaataccccagtcatataagacttggaacattgcatctgagccactaatctttgtcatagtctataagcatctccttaatgttttttcttacaccttgattaaagcacatttgtaacacaattgaaagcggttgctgtgactgctagtcctgtatttactcattatcaaaaataattaattcacaaactatttactcttctttcacaacttatcattaggtagcaactttaaactgtgattaagtgatcatactcaacaaaaaaagcaaaaaaattttttattttttttgctttaaaactaattatttatttttcacttttgcaattcggccttgttgaatatatgccgttaatattgccaaatcagctggatttacaccagaaattctttcagcttgagcaattgactcaggacgaatcttttcaaatttttgacgtgcctcagttgccaaacttggaattgcgttgtagtcaatatctactggaattttctttgattcaagtcgatgcaaacgatcaaccaaggtcttttccttcttgatatacccttcatatttcaatgcaatttcaacttgttctttcacatagcgatcagtagctaaagtttcaccacttaatctttcaactgcgtcaaaagttacacgtggtcgcttcaaaaagtctgcgccgctaactcctgcattcaaacgatcttgcttaacactagctaaatattcttgaacctcatcagtagggtgaatggtaactttcttaatagcttccattgcctgggaaatagcttgctttttatcttggaattccttataacgatcttctgaaatcaagcctaattcatgacctttttcagtcaaacgcaaatctgcattatcgtgacgaagaagaagacgatattctgcccggctagttagcaaacgatatggttcatttgttcctttagttactaagtcatcaattaagaccccaatatatgcttcatcacgttgtaaagtaaatccaggcttattttgagcacttaaggctgcattgataccagcaattaatccttgaccggctgcttcttcataacccgatgttccgttcatttgaccagcagtgaagaggtgcttaatattttttgtctctaatgtatgctttaattgccaaggttcaattacgtcatattcaattgcatatcctgggcgcattaattctgctttttctagaccagcaacactatgaagcatcttcaattgtacttcttcaggcattgaagtagaaaagtcacctacgtatatttccttagtatggcgtccttctggttccaagaaaatttggtgacgatctttatctgcaaaacgaactaccttatcttcaattgaaggacagtaacgtgggcctacacccttgataaccccagaaaacattggagcacgatcaagatttgcacgaataatatcatgcgttacggtattagtgtaagtcatataacaagacatttgatcttctaggtaatcactatctttgctagtgtaagaaaaatgtcttggttctttgtctccaggctcttcttgagtttttgaataatcaatagtatttccatccactcgaggaggagtaccagtcttaaaacgacgtaatttaaagcctaacttttcaagattttcaggtaatttaatagatggaagtgagttattaggacctgaagaataagccaattctccaataataatttttcctctagcagctgttcctgtggtcaagacaacgcttttagcatagtactttgcaccagtattagtaatcaaccctttacatactccatcttcaacgatcaactcatctgcaacagcttgacgtaaagttaaattaggctcgttttcaattgtatctttcatacgctcatgatattgccatttatcggcttgtgccctcaacgctctaacagccgggcccttacctgtattgagcattctcatttgaatataagtggcatcaatgtttttacccatttctccgccaagagcatcgatttcacgcacaacagtaccctttgctggtccaccaactgatggattacatggcatgaaagctaccatgtctaaattgatcgttaaaagaagcgtcttttctcccattcgtgctgatgctaaggctgcttctactcccgcatggcctgctccaacaacaattacatcatattcatttgattcgtaagtcttcattttcatcctactttccaagacagaattgactaaataattgggtaattaattcatcaggtgcactttcaccagtaatttcacccaaagtatcccaagcatttttgagatcaatttgaaccaaatctaaaggcattgcatcatcaattccattgacaacgtcttctaaagattgctttgctttggctaataaaccagcttgtctttgatttgtcaccaagatttgattttgtgaattttctattccgctaaagaataattgctcaattgcattctcaagcgcagccatattttcttgctttaagattgaagttacaataattggattatcagtaatttctcttatcatttcctgggaaatttttgtgcctagatcttgtttgtttaaaatgataattcgttttttattagcagttaaatttaataaatttttatcttcgtctgttaaatcttgacttgcatccagaagtaaaagcaccaaatcagcttcagcgatagctttctttgaacgttcaactccaattttttcgaccttgtcttctgtatggtgaatcccagcagtatcaatcagcttcagcggtacgcctttaacagaaacatattcttcaagtgtatctcttgttgttcccgcaatatcagtaacaattgccttatcgtcctgcgttaaataatttaaaagagaggatttaccaacatttggtcttcccacgatagccgttgctagaccattacggataattttcccttcctgagctgtttttagcaattgatcaatttgctttgaaacttcttcggccttcttcttcatttcttgagaagttaaatcgtccatatcatattctggataatcaatattcacttcttcatgagccattgtatctaaaagttcttgacgcattgttctgattttatctaacaatccaccagctaattgtgtcatagcaacttgacgagacttatccgtcttagcccgaacaatatccattacagattcagcttgtgtcaagtcaatacgaccattcataaaggcgcgcttagtaaattcacccggatcagccattcgagcaccgtttgccaaaagtagctgcaaaatatcattagttacaatcattccaccatgacaattgatttcaaccatatcttctcgagtgaaagtttttggtgcgcgtaatacactaaccattgtctcgtctacaacatccttagttttaggatcaacgatatgtccataatgaattgtatgtgagggaacctgagttaaatctgctcctttaaaaagtttattagcaatcgctactgcatcttcaccagatagacgaacaattgatatacctccttcgccaataggagtagaaattgcagcgattgtatcaaattgtgttaatacttgtgccattttttcacctacataaaataatcttaataaaaaaagtgcccactccaccactacaaaaaataatgatggataaagcactttgactactttatcttcaaattaaagataatttatttttgttgtttacgtcctaaacgtttgtatgcgcgacgaactttgcgctgacgttcacgttcttccttcttttgttcctcaagttcacgttgatacttgaatggattttgcaaaataaaggtttgaactacttggaataagttggaaatcacccagtaaagtgaaatcgcagattggataccaattgctgaaaccccaataataagaggcatcaagtatgtcattcccttagtcattccattttgtgaggattggggcgttgacatctgactgatgtacgtactcataaaagtgaatacagccgccaagataggcatgatgtaatatggatcgggacgtcccaaatccatccacaaaaaccgaccattttgcaactgtggagtccgccaaattgcttgatacaaagcatacataactggtagttgaattaacattggtaaacatccagtatatggattaataccagcttctttatacaacttgctagtttcttcttgtaacttttgacgtgactcaacatccttacctggatactttttacgcaatgcatccatctgtggttgcactttttgttgcttagccatgcttctaatagaaatggcattcaatggtaataaaattattcttactataatagtaaagataatgattgcccaaccataggaatcatgaactaaacttgcaatccaaagaataaattgggaaatatagtaaacaatataccgatcccaccaattgccactagtatgagaaataggagcaacacttgttccattagttgatgcacaacctgtaactactaacgttaaggcaagcattcctaaagctaatagaatcagtttccaatttttcttagacaaatgatttctcactctacttttcctcaatttccgtctcttcgctcgataagaccttggctaaccttaaaacatgaataagattctttttggttcgtcccatatcaaaatctcgtgcataaggtcgagctattactaaaaagtctaaatcaggccttatctctggcttaagttctgtcagtgtagcacgaatgaaccgtttgaggcgattacgtgctaccgccgtatgacctacttttttcccaacagaaattccaacgcgaaaatgcttttgattttctttgggtaaggtatagacaacaaagccgcgattagccattgactgtccttctttaaaaactttttgaaagtctctctcagtttttacacggtagctttttctcaatctggttcatccttacttaaattaaaaaaaccactgagcttcagtggcttaagcagataagacttttctaccctttttacggcgtcttgctaaaaccttgcggccgtttgctgtagccatacgtttcataaaaccatgaacgcgtgaacggtgacgcttcttaggttggtaagttctcttagttgacatttaatgttgcacctccgtttttcaatgcttaataagcacaatttctaagatagaatagcatatttacgcgaaaaaaccaaggccttatcaaaattttcctaaaaagaaaagttatttttaaagcatttttcaaattattttttgtggatatctttttttaaattttttatttattttttatcaacaagatcattctcagagttatgcacaattcacaccctgtttagaacaaaataaacaccctgtggaaaatataacctatttagcataaagtgttgatttatggcatataataaactcacatattgctgtggaaaacttaaacttgaaattttatttcacacttcggtggatttctatttttatattatccacatacctgtgaatttgttaattctttttattacttgtggaaaacttatttaattcatgctacacttattttgacttattctgtggataatacagtatttggaggaatttttnnnnnnnnnnaaatggaggattagctcagctgggagagcatctgccttacaagcaggaggtcacaggttcgagccctgtatcctccattgagtcgttagctcagttggtagagcatctgacttttaatcagagggtcggcagttcgagcctgccacgactcattggcccagaaaaaactcaagcgggtgtggcggaattggcagacgcgctagatttaggttctagtgttttcggacgtgtgggttcaagtcccaccacccgtaccatgccgatttagctcagttggtagagcatctgtcttgtaaacagggggtcgaaggttcgagtcctttaatcggcataaaaattgaataaaaatgcggaagtagttcagtggtagaacaccaccttgccatggtgggggtcgcgggttcgaatcccgtcttccgcttatcattatcatgccggggtggcggaactggcagacgcacgggacttaaaatcccgcggttggtgacaaccgtaccggttcgattccggtcctcggcatataatgatgcacccttagcgcaactggatagagtgtctgactacgaatcagaaggttgaaggttcaaatccttcagggtgcacacttcgggaagtggctcagtttggtagagcacctggtttgggaccagggggtcgcaggttcgaatcctgtcttcccgattgtagcttaataagaaggaagttacagatggcggtgtagctcagctggctagagcgtccggttcatacccgggaggtcgagggttcgatcccccccgccgctatagaggtaaacttggacctttagctcagttggttagagcagacggctcataaccgtcgggtcgtaggttcgagtcctacaaggtccataggatcttggctttttttatataaaaacatcgcgggatggagcagtctggtagctcgtcgggctcataacccgaaggtcataggttcaaatcctgttcccgcaatatggtcccttggtgtaggggttatcacgcctccctgtcacggaggagatcaccggtccgaatccggtagggaccgtaatggctcgatagctcagttggtagagcaaaggattgaagctccttgtgtcggcggttcgattccgtctcgcgccattaggaagcaagaagttgcgggtatagtttagtggtaaaacgaaagccttccaagctttagtcgcgagtccgattctcgttacccgcttcaaaggaaaggggcctatagctcagctggttagagcgcacgcctgataagcgtgaggtcgatggttcaagtccatttaggcccattggagatttactcaagtggctgaagaggcgcccctgctaagggtgtaggtcggtttataccggcgcgagggttcgaatctctcaatctccgctttacagatatgcttcattaactaccttaatgaggcattttattttcctttgattaaaatctgtaaagtaatacatgctgtttgaggtaagcgaaaagagcaaataaaaaagttcaaaaaaagcttgccaaagcgagcaaaagatgataatattataaagctgtcatttgagagagatgagaaaattaaaaaagttcttgtcaaagcttaaaagacatgatataatataaaagttgtcacatgacaacggtagtaccttgaaaactgaacaaagtttcgctgaaagtgtgcgggatataaaaatcccaaacaaaagcgaagtcaattcgcaagcaataaatttgagataactcaaagaaagttttagagctaaacgataaaaagctcattttcaaaaggaaaatgagagtttgatcctggctcaggacgaacgcnnnnnnnnnntcgtaacaaggtagccgtaggagaacctgcggctggatcacctcctttctaaggaaggcgaaagatgatggagagtgcgagagcactaagagaagtcatcgagaaagccaagcggaagcacactgagaaactttgtttagttttgagggtattacctcaaacaacttgaataacaagccaagcataatcgggcctatagctcagctggttagagcgcacgcctgataagcgtgaggtcgatggttcaagtccatttaggcccattcaaagcaaaaaagctttgataaaaggcaatgatgggggcttagctcagatgggagagcgcctgctttgcacgcaggaggtcatcggttcgatcccgttagcctccattgagacataaagtctcaagggttagtacattgaaaactgaatataatcaaaagcaaaaaaaccgagacaatcgaaaaaacagattgaagagcgaccgagaagagagagaaactcaacttgaaata

What is claimed is:

1. A method for elucidating a biological function of a protein involved in an interaction between a host and a bacteria, said method comprising:

introducing a nucleotide sequence comprising an entire open reading frame that codes for the protein into the bacteria;

expressing the protein in the bacteria;

contacting the host with the bacteria; and determining the interaction between the host and the bacteria, wherein the interaction between the host and the bacteria elucidates the function of the protein and wherein the nucleotide sequence that comprises an entire open reading frame coding for the protein is SEQ ID NO: 1 or a fragment thereof.

2. The method according to claim 1, wherein the protein functions as a probiotic, anti-pathogenic or anti-viral.

3. The method according to claim 1, wherein the protein functions as a probiotic for stimulating the immune system.

4. The method according to claim 1, wherein the fragment of SEQ ID. No. 1 is selected from the group consisting of: nucleotides 1-54596, 56070-77430; 81302-308537, 309588-342757, 378458-389217, 389779-404510, 405561-501116, 503873-558194, 563262-696518, 697569-721736, 722787-756845, 761682-860446, 860723-865550, 867260-867490, 868541-1448288, 1463851-1526077, 1527278-1552024, 1563147-1809115, 1810166-1858190, 1863258-1872871, 1877939-1930430, and 1932063-1983043, based on the numbering of SEQ ID. No. 1.

* * * * *